United States Patent 12,134,655 (CANCER ASSOCIATED ANTIBODY COMPOSITIONS AND METHODS OF USE) - sequence listing, part 2

SEQ ID NO: 4443 - protein, 490 aa, Homo sapiens
MFIGATFCAPRGASASRAYVPTAWKNLPATSETFPATSRVFPSTSHFQPASSNAFRGPSAASESPKSLPFALQDPYACVEALPAVPWVPYPDGNASSACKSVPAILMVAAAAPQASATAAEASKSSEPPRRPGKATRKKKHLEPKEDNCGHRLSSRDWRGPRTWGNPSHSDWEIQRAMQLLGDRESLYTPQGLNDWGCPNTSRMPRSLEGPSTSRDQEFCGDSGGSQTWMASEVPSVSRGSSAAQEDPDRESQPLSPLDERANALVQFLLVKDQAKVPVQLSEMVNVVIREYKDDSLDIINRANTKLECTFGCQLKEVDTKTHTYIIVNKMAYPQCNLLASYLERPKFSLLMVVLSLIFMKGYCIRENLLFSFLFQLGLDVQETSGLFRITKKLITSVFVRHRYLEYRQIPFTEPAEYELLWGPRAFLETNRVHILRFLAALYENQPQIWSCQYLDSLAELEYKDANAAAEESHDSDDDAHDPTSSPHPH

SEQ ID NO: 4444 - protein, 164 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 4445 - protein, 620 aa, Homo sapiens
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 4446 - protein, 329 aa, Homo sapiens [sequence omitted]

SEQ ID NO: 4447 - protein, 624 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 4448 - protein, 655 aa, Homo sapiens
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTLEFLRNPAMMQEMIRSQDRVLSNLESIPGGYNVLCTMYTDIMDPMLNAVQEQFGGNPFATATTDNATTTTSQPSRMENCDPLPNPWTSTHGGSGSRQGRQDGDQDAPDIRNRFPNFLGIIRLYDYLQQLHENPQSLGTYLQGTASALSQSQEPPPSVNRVPPSSPSSQEPGSGQPLPEESVAIKGRSSCPAFLRYPTENSTGQGGDQDGAGKSSTGHSTNLPDLVSGLGDSANRVPFAPLSFSPTAAIPGIPEPPWLPSPAYPRSLRPDGMNPAPQLQDEIQPQLPLLMHLQAAMANPRALQALRQIEQGLQVLATEAPRLLLWFMPCLAGTGSVAGGIESREDPLMSEDPLPNPPPEVFPALDSAELGFLSPPFLHMLQDLVSTNPQQLQPEAHFQVQLEQLRSMGFLNREANLQALIATGGDVDAAVEKLRQS

SEQ ID NO: 4449 - protein, 166 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 4450 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 4451 - protein, 348 aa, Homo sapiens
MGHCCCKPYNCLQCLDKTNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 4452 - protein, 475 aa, Homo sapiens
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 4453 - protein, 875 aa, Homo sapiens
MERAGPSFGQQRQQQQPQQQKQQQRDQDSVEAWLDGHWDFTFSYFVRKATREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFRMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 4454 - protein, 419 aa, Homo sapiens [sequence omitted]

SEQ ID NO: 4455 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 4456 - protein, 273 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLAEEQLRIVEEQRKIHEERMKLEQERQRQQKEEQKIILGKGKSRPKLSFSLKTQD

SEQ ID NO: 4457 - protein, 490 aa, Homo sapiens [sequence omitted]

SEQ ID NO: 4458 - protein, 377 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 4459 - protein, 276 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 4460 - protein, 227 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 4461 - protein, 576 aa, Homo sapiens
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRRTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 4462 - protein, 642 aa, Homo sapiens
MEEERKTAELQKNRIQDSVVFEDVAVDFTQEEWALLDLAQRNLYRDVMLENFQNLASLGYPLHTPHLISQWEQEEDLQTVKRELIQGIFMGEHREGFETQLKTNESVASQDICGEKISNEQKIVRFKRNDSWFSSLHENQESCGIDYQNKSHERHLRNHMVENIYECYEENQDGQTFSQVPNLDSLKRNTEVKSCECHECGKAFVDHSSLKSHIRSHTGSKPYQCKECGKAFHFLACFKKHMKTPTEEKPYECKECTKAFSCSSFFRAHMKIHIGKTNYECKECGKGFSCSSSLTEHKRIHSGDKPYECKECGKAFSCSSSLSKHKRIHSGDKPYECKECGKAFSSSSHLIIHIRIHTGEKPYECKECGKAFSESSKLTVHGRTHTGEKPYKCKECGKAYNCPSSLSIHMRKHTGEKPYECLECGKAFYLPTSLNTHVKNQSREKPYECKECGKAFSCPSSFRAHVRDHTGKIQYECKECGKTFSRSSSLTEHLRTHSGEKPYECKECGKAFISSSHLTVHIRTHTGEKPYECKKCGKAFIYPSALRIHMRTHTGEKPYECKECGKAFRHSSYLTVHARMHTGEKPFECLECGKAFSCPSSFRRHVRSHTGEKPYECKECGKAFVCPAYFRRHVKTHTRENI

SEQ ID NO: 4463 - protein, 111 aa, Homo sapiens
MSELLRARSQSSERGNDQESSQPVGSVIVQEPTEEKRQEEEPPTDNQGIAPSGEIENQAVPAFQGPDMEAFQQELALLKIEDEPGDGPDVREGIMPTFDLTKVLEAGDAQP

SEQ ID NO: 4464 - protein, 96 aa, Homo sapiens
MCHTSCSPACQPTCCIHSPCQASCYVPVSCQSSVCMPVSCTRIVCVAPSCQPSVCVPVSCRPIIYVTPSCQSSGCCQPPCTTALCRPISCSTPSCC

SEQ ID NO: 4465 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 4466 - protein, 251 aa, Homo sapiens
MEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGRLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 4467 - protein, 900 aa, Homo sapiens
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 4468 - protein, 376 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRVANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 4469 - protein, 273 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 4470 - protein, 99 aa, Homo sapiens
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 4471 - protein, 230 aa, Homo sapiens
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFKALLQLDPCENKIKWINFLALGCSMLGGSLNTALKHLCEILTDDREGGPARIPFKTFSYVYRYLARLDSDVSPLETESYLASLKENIDARKNGMIGLSDFFFPKRKLLESIENSEDVGH

SEQ ID NO: 4472 - protein, 378 aa, Homo sapiens
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPGCPDIDIFVDGKRFKAHRAILSARSSYFAAMLSGCWAESSQEYVTLQGISHVELNVMMHFIYGGTLDIPDKTNVGQILNMADMYGLEGLKEVAIYILRRDYCNFFQKPVPRTLTSILECLIIAHSVGVESLFADCMKWIVKHFARFWSERSFANIPPEIQKSCLNMLIQSLVNIT

SEQ ID NO: 4473 - protein, 348 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPPPLTSPSHGSLSHSKAPSGSQMSHNAVTSHQRPGWPGQPHSPFPHPTPHFQPDASLLQPVTPLGTSRWRKISAALPY

SEQ ID NO: 4474 - protein, 519 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKVDASPPTN

SEQ ID NO: 4475 - protein, 199 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKPGGAR

SEQ ID NO: 4476 - protein, 327 aa, Homo sapiens
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 4477 - protein, 631 aa, Homo sapiens
MSHWAPEWKRAEANPRDLGASWDVRGSRGSGWSGPFGHQGPRAAGSREPPLCFKIKNNMVGVVIGYSGSKIKDLQHSTNTKIQIINGESEAKVRIFGNREMKAKAKAAIETLIRKQESYNSESSVDNAASQTPIGRNLGRNDIVGEAEPLSNWDRIRAAVVECEKRKWADLPPVKKNFYIESKATSCMSEMQVINWRKENFNITCDDLKSGEKRLIPKPTCRFKDAFQQYPDLLKSIIRVGILKPTPIQSQAWPIILQGIDLIVVAQTGTGKTLSYLMPGFIHLDSQPISREQRNGPGMLVLTPTRELALHVEAECSKYSYKGLKSICIYGGRNRNGQIEDISKGVDIIIATPGRLNDLQMNNSVNLRSITYLVIDEADKMLDMEFEPQIRKILLDVRPDRQTVMTSATWPDTVRQLALSYLKDPMIVYVGNLNLVAVNTVKQNIIVTTEKEKRALTQEFVENMSPNDKVIMFVSQKHIADDLSSDFNIQGISAESLHGNSEQSDQERAVEDFKSGNIKILITTDIVSRGLDLNDVTHVYNYDFPRNIDVYVHRVGYIGRTGKTGTSVTLITQRDSKMAGELIKILDRANQSVPEDLVVMAEQYKLNQQKRHRETRSREPGQRRKEFYFLS

SEQ ID NO: 4478 - protein, 636 aa, Homo sapiens
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 4479 - protein, 369 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 4480 - protein, 680 aa, Homo sapiens
MGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNLSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 4481 - protein, 731 aa, Homo sapiens [sequence omitted]

SEQ ID NO: 4482 - protein, 40 aa, Homo sapiens
MGLTKQYLRYVASAVFGVIGSQKGLASQASSSFVFFATEF

SEQ ID NO: 4483 - protein, 925 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 4484 - protein, 303 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 4485 - protein, 217 aa, Homo sapiens
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 4486 - protein, 223 aa, Homo sapiens
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADSDDNMDEATY

SEQ ID NO: 4487 - protein, 522 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 4488 - protein, 154 aa, Homo sapiens [sequence omitted]

SEQ ID NO: 4489 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 4490 - protein, 303 aa, Homo sapiens
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 4491 - protein, 296 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 4492 - protein, 451 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 4493 - protein, 758 aa, Homo sapiens
MSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 4494 - protein, 165 aa, Homo sapiens
MKLFGFRSRRGQTVLGSIDHLYTGSGYRIRYSELQKIHKAAVKGDAAEMERCLARRSGDLDALDKQHRTALHLACASGHVKVVTLLVNRKCQIDIYDKENRTPLIQAVHCQEEACAVILLEHGANPNLKDIYGNTALHYAVYSESTSLAEKLLFHGENIEALDKV

SEQ ID NO: 4495 - protein, 757 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 4496 - protein, 1035 aa, Homo sapiens
MAAETLNFGPEWLRALSGGGSVASPPPSPAMPKYKLADYRYGREEMLALYVKENKVPEELQDKEFAAVLQDEPLQPLALEPLTEEEQRNFSLSVNSVAVLRLMGKGAGPPLAGTSRGRGSTRSRGRGRGDSCFYQRSIEEGDGAFGRSPREIQRSQSWDDRGERRFEKSARRDGARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRAKREEEERKRREEKRRQQQQEEQKRRQEEEELFRRKHVRQQELLLKLLQQQQAVPVPPAPSSPPPLWAGLAKQGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 4497 - protein, 94 aa, Homo sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 4498 - protein, 348 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 4499 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 4500 - protein, 233 aa, Homo sapiens
MDNQGVIYSDLNLPPNPKRQQRKPKGNKSSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 4501 - protein, 568 aa, Homo sapiens
MGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 4502 - protein, 237 aa, Homo sapiens
MALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 4503 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 4504 - protein, 314 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 4505 - protein, 359 aa, Homo sapiens
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 4506 - protein, 639 aa, Homo sapiens
MSARGPAIGIDLGTTYSCVGVFQHGKVEIIANDQGNRTTPSYVAFTDTERLIGDAAKNQVAMNPTNTIFDAKRLIGRKFEDATVQSDMKHWPFRVVSEGGKPKVQVEYKGETKTFFPEEISSMVLTKMKEIAEAYLGGKVHSAVITVPAYFNDSQRQATKDAGTITGLNVLRIINEPTAAAIAYGLDKKGCAGGEKNVLIFDLGGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 4507 - protein, 211 aa, Homo sapiens
MAQAKINAKANEGRFCRSSSMADRSSRLLESLDQLELRVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 4508 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 4509 - protein, 205 aa, Homo sapiens
MMPRHLLPHSGITSLRRVPRRRLPSRRREDFRRFLFLSFVSTDKDGDPTGQASPAVPVPHFTTWGSLIPIDSQRNKERTRFTWMDGPPHGGLGTRFSGRGSASLTAPPGRCFTRERHPVPRQRKCRRQHSTGRKPHCGTRSAAPRNPKSIHKRSFSAKSLKNKTRNESPPVSALVSRTKTQPGQLHFCCQPSSSQAPASRRAKGR

SEQ ID NO: 4510 - protein, 794 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 4511 - protein, 191 aa, Homo sapiens
MGGSGSRLSKELLAEYQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 4512 - protein, 514 aa, Homo sapiens
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 4513 - protein, 278 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 4514 - protein, 177 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 4515 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 4516 - protein, 263 aa, Homo sapiens
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVAKLIPWVQKILAAN

SEQ ID NO: 4517 - protein, 356 aa, Homo sapiens
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 4518 - protein, 126 aa, Homo sapiens
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRGIIHARALVRECLAETERNART

SEQ ID NO: 4519 - protein, 398 aa, Homo sapiens
MMWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFSFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQSRMDVYMSHAPTGSSVHNILHIKQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 4520 - protein, 566 aa, Homo sapiens
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 4521 - protein, 493 aa, Homo sapiens
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLDQLLSTLQSPLESLELAFCALLPEDLRFLARSPHAAHLKKLDLSGNDLSGSQLAPFQGLLQASAATLLHLELTECQLADTQLLATLPILTQCASLRYLGLYGNPLSMAGLKELLRDSVAQAELRTVVHPFPVDCYEGLPWPPPASVLLEASINEEKFARVEAELHQLLLASGRAHVLWTTDIYGRLAADYFSL

SEQ ID NO: 4522 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 4523 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 4524 - protein, 472 aa, Homo sapiens
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 4525 - protein, 278 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGSHSVAQAGVQWCDLGSLQPPPPWFG

SEQ ID NO: 4526 - protein, 622 aa, Homo sapiens
MAENTEGDLNSNLPHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDITTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 4527 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 4528 - protein, 328 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 4529 - protein, 237 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFDLWYTLDRPPIGPWSAEGATLLSNSAQFH

SEQ ID NO: 4530 - protein, 282 aa, Homo sapiens
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 4531 - protein, 301 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 4532 - protein, 599 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 4533 - protein, 362 aa, Homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 4534 - protein, 116 aa, Homo sapiens
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 4535 - protein, 210 aa, Homo sapiens
MDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQVVKIIRPSETAGRYITYRLVQ

SEQ ID NO: 4536 - protein, 217 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 4537 - protein, 597 aa, Homo sapiens
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 4538 - protein, 350 aa, Homo sapiens
MGCFFSKRRKADKESRPENEEERPKQYSWDQREKVDPKDYMFSGLKDETVGRLPGTVAGQQFLIQDCENCNIYIFDHSATVTIDDCTNCIIFLGPVKGSVFFRNCRDCKCTLACQQFRVRDCRKLEVFLCCATQPIIESSSNIKFGCFQWYYPELAFQFKDAGLSIFNNTWSNIHDFTPVSGELNWSLLPEDAVVQDYVPIPTTEELKAVRVSTEANRSIVPISRGQRQKSSDESCLVVLFAGDYTIANARKLIDEMVGKGFFLVQTKEVSMKAEDAQRVFREKAPDFLPLLNKGPVIALEFNGDGAVEVCQLIVNEIFNGTKMFVSESKETASGDVDSFYNFADIQMGI

SEQ ID NO: 4539 - DNA, 42 bp, Artificial Sequence
  synthetic construct
tggaccctgtggacacagccacatattactgtgcacacagac

SEQ ID NO: 4540 - DNA, 90 bp, Artificial Sequence
  synthetic construct
tggaccctgtggacacagccacatatttttgtgcacacaagaaccttcagtattcggaatggttcgacccctggggccagggcaccctgg

SEQ ID NO: 4541 - DNA, 51 bp, Artificial Sequence
  synthetic construct
acaactggttcgactcctggggccaaggaaccctggtcaccgtctcctcag

SEQ ID NO: 4542 - protein, 220 aa, Artificial Sequence; identical to SEQ ID NO: 1
  synthetic construct

SEQ ID NO: 4543 - protein, 220 aa, Artificial Sequence; identical to SEQ ID NO: 2
  synthetic construct

SEQ ID NO: 4544 - protein, 223 aa, Artificial Sequence; identical to SEQ ID NO: 3
  synthetic construct

SEQ ID NO: 4545 - protein, 119 aa, Artificial Sequence; identical to SEQ ID NO: 4
  synthetic construct

SEQ ID NO: 4546 - protein, 223 aa, Artificial Sequence; identical to SEQ ID NO: 5
  synthetic construct

SEQ ID NO: 4547 - protein, 221 aa, Artificial Sequence; identical to SEQ ID NO: 6
  synthetic construct

SEQ ID NO: 4548 - protein, 122 aa, Artificial Sequence; identical to SEQ ID NO: 7
  synthetic construct

SEQ ID NO: 4549 - protein, 222 aa, Artificial Sequence; identical to SEQ ID NO: 8
  synthetic construct

SEQ ID NO: 4550 - protein, 124 aa, Artificial Sequence; identical to SEQ ID NO: 9
  synthetic construct

SEQ ID NO: 4551 - protein, 221 aa, Artificial Sequence; identical to SEQ ID NO: 10
  synthetic construct

SEQ ID NO: 4552 - protein, 222 aa, Artificial Sequence; identical to SEQ ID NO: 11
  synthetic construct

SEQ ID NO: 4553 - protein, 118 aa, Artificial Sequence; identical to SEQ ID NO: 12
  synthetic construct

SEQ ID NO: 4554 - protein, 222 aa, Artificial Sequence; identical to SEQ ID NO: 13
  synthetic construct

SEQ ID NO: 4555 - protein, 225 aa, Artificial Sequence; identical to SEQ ID NO: 14
  synthetic construct

SEQ ID NO: 4556 - protein, 222 aa, Artificial Sequence; identical to SEQ ID NO: 15
  synthetic construct

SEQ ID NO: 4557 - protein, 216 aa, Artificial Sequence; identical to SEQ ID NO: 16
  synthetic construct

SEQ ID NO: 4558 - protein, 218 aa, Artificial Sequence; identical to SEQ ID NO: 17
  synthetic construct

SEQ ID NO: 4559 - protein, 222 aa, Artificial Sequence; identical to SEQ ID NO: 18
  synthetic construct

SEQ ID NO: 4560 - protein, 219 aa, Artificial Sequence; identical to SEQ ID NO: 19
  synthetic construct

SEQ ID NO: 4561 - protein, 216 aa, Artificial Sequence; identical to SEQ ID NO: 20
  synthetic construct

SEQ ID NO: 4562 - protein, 223 aa, Artificial Sequence; identical to SEQ ID NO: 21
  synthetic construct

SEQ ID NO: 4563 - protein, 115 aa, Artificial Sequence; identical to SEQ ID NO: 22
  synthetic construct

SEQ ID NO: 4564 - protein, 215 aa, Artificial Sequence; identical to SEQ ID NO: 23
  synthetic construct

SEQ ID NO: 4565 - protein, 213 aa, Artificial Sequence; identical to SEQ ID NO: 24
  synthetic construct

SEQ ID NO: 4566 - protein, 220 aa, Artificial Sequence; identical to SEQ ID NO: 25
  synthetic construct

SEQ ID NO: 4567 - protein, 221 aa, Artificial Sequence; identical to SEQ ID NO: 26
  synthetic construct

SEQ ID NO: 4568 - protein, 222 aa, Artificial Sequence; identical to SEQ ID NO: 27
  synthetic construct

SEQ ID NO: 4569 - protein, 119 aa, Artificial Sequence; identical to SEQ ID NO: 28
  synthetic construct

SEQ ID NO: 4570 - protein, 219 aa, Artificial Sequence; identical to SEQ ID NO: 29
  synthetic construct

SEQ ID NO: 4571 - protein, 216 aa, Artificial Sequence; identical to SEQ ID NO: 30
  synthetic construct

SEQ ID NO: 4572 - protein, 222 aa, Artificial Sequence; identical to SEQ ID NO: 31
  synthetic construct

SEQ ID NO: 4573 - protein, 226 aa, Artificial Sequence; identical to SEQ ID NO: 32
  synthetic construct

SEQ ID NO: 4574 - protein, 218 aa, Artificial Sequence; identical to SEQ ID NO: 33
  synthetic construct

SEQ ID NO: 4575 - protein, 121 aa, Artificial Sequence; identical to SEQ ID NO: 34
  synthetic construct

SEQ ID NO: 4576 - protein, 219 aa, Artificial Sequence; identical to SEQ ID NO: 35
  synthetic construct

SEQ ID NO: 4577 - protein, 218 aa, Artificial Sequence; identical to SEQ ID NO: 36
  synthetic construct

SEQ ID NO: 4578 - protein, 215 aa, Artificial Sequence; identical to SEQ ID NO: 37
  synthetic construct

SEQ ID NO: 4579 - protein, 220 aa, Artificial Sequence; identical to SEQ ID NO: 38
  synthetic construct

SEQ ID NO: 4580 - protein, 220 aa, Artificial Sequence; identical to SEQ ID NO: 39
  synthetic construct

SEQ ID NO: 4581 - protein, 216 aa, Artificial Sequence; identical to SEQ ID NO: 40
  synthetic construct

SEQ ID NO: 4582 - protein, 223 aa, Artificial Sequence; identical to SEQ ID NO: 41
  synthetic construct

SEQ ID NO: 4583 - protein, 221 aa, Artificial Sequence; identical to SEQ ID NO: 42
  synthetic construct

SEQ ID NO: 4584 - protein, 223 aa, Artificial Sequence; identical to SEQ ID NO: 43
  synthetic construct

SEQ ID NO: 4585 - protein, 123 aa, Artificial Sequence; identical to SEQ ID NO: 44
  synthetic construct

SEQ ID NO: 4586 - protein, 118 aa, Artificial Sequence; identical to SEQ ID NO: 45
  synthetic construct

SEQ ID NO: 4587 - protein, 229 aa, Artificial Sequence; identical to SEQ ID NO: 46
  synthetic construct

SEQ ID NO: 4588 - protein, 221 aa, Artificial Sequence; identical to SEQ ID NO: 47
  synthetic construct

SEQ ID NO: 4589 - protein, 217 aa, Artificial Sequence; identical to SEQ ID NO: 48
  synthetic construct

SEQ ID NO: 4590 - protein, 218 aa, Artificial Sequence; identical to SEQ ID NO: 49
  synthetic construct

SEQ ID NO: 4591 - protein, 226 aa, Artificial Sequence; identical to SEQ ID NO: 50
  synthetic construct

SEQ ID NO: 4592 - protein, 216 aa, Artificial Sequence; identical to SEQ ID NO: 51
  synthetic construct

SEQ ID NO: 4593 - protein, 221 aa, Artificial Sequence; identical to SEQ ID NO: 52
  synthetic construct

SEQ ID NO: 4594 - protein, 117 aa, Artificial Sequence; identical to SEQ ID NO: 53
  synthetic construct

SEQ ID NO: 4595 - protein, 224 aa, Artificial Sequence; identical to SEQ ID NO: 54
  synthetic construct

SEQ ID NO: 4596 - protein, 218 aa, Artificial Sequence; identical to SEQ ID NO: 55
  synthetic construct

SEQ ID NO: 4597 - protein, 124 aa, Artificial Sequence; identical to SEQ ID NO: 56
  synthetic construct

SEQ ID NO: 4598 - protein, 224 aa, Artificial Sequence; identical to SEQ ID NO: 57
  synthetic construct

SEQ ID NO: 4599 - protein, 215 aa, Artificial Sequence; identical to SEQ ID NO: 58
  synthetic construct

SEQ ID NO: 4600 - protein, 218 aa, Artificial Sequence; identical to SEQ ID NO: 59
  synthetic construct

SEQ ID NO: 4601 - protein, 218 aa, Artificial Sequence; identical to SEQ ID NO: 60
  synthetic construct

SEQ ID NO: 4602 - protein, 221 aa, Artificial Sequence; identical to SEQ ID NO: 61
  synthetic construct

SEQ ID NO: 4603 - protein, 223 aa, Artificial Sequence; identical to SEQ ID NO: 62
  synthetic construct

SEQ ID NO: 4604 - protein, 218 aa, Artificial Sequence; identical to SEQ ID NO: 63
  synthetic construct

SEQ ID NO: 4605 - protein, 224 aa, Artificial Sequence; identical to SEQ ID NO: 64
  synthetic construct

SEQ ID NO: 4606 - protein, 218 aa, Artificial Sequence; identical to SEQ ID NO: 65
  synthetic construct

SEQ ID NO: 4607 - protein, 218 aa, Artificial Sequence; identical to SEQ ID NO: 66
  synthetic construct

SEQ ID NO: 4608 - protein, 212 aa, Artificial Sequence; identical to SEQ ID NO: 67
  synthetic construct

SEQ ID NO: 4609 - protein, 220 aa, Artificial Sequence; identical to SEQ ID NO: 68
  synthetic construct

SEQ ID NO: 4610 - protein, 220 aa, Artificial Sequence; identical to SEQ ID NO: 69
  synthetic construct

SEQ ID NO: 4611 - protein, 222 aa, Artificial Sequence; identical to SEQ ID NO: 70
  synthetic construct

SEQ ID NO: 4612 - protein, 222 aa, Artificial Sequence; identical to SEQ ID NO: 71
  synthetic construct

SEQ ID NO: 4613 - protein, 223 aa, Artificial Sequence; identical to SEQ ID NO: 72
  synthetic construct

SEQ ID NO: 4614 - protein, 119 aa, Artificial Sequence; identical to SEQ ID NO: 73
  synthetic construct

SEQ ID NO: 4615 - protein, 218 aa, Artificial Sequence; identical to SEQ ID NO: 74
  synthetic construct

SEQ ID NO: 4616 - protein, 216 aa, Artificial Sequence; identical to SEQ ID NO: 75
  synthetic construct

SEQ ID NO: 4617 - protein, 226 aa, Artificial Sequence; identical to SEQ ID NO: 76
  synthetic construct

SEQ ID NO: 4618 - protein, 224 aa, Artificial Sequence; identical to SEQ ID NO: 77
  synthetic construct

SEQ ID NO: 4619 - protein, 222 aa, Artificial Sequence; identical to SEQ ID NO: 78
  synthetic construct

SEQ ID NO: 4620 - protein, 227 aa, Artificial Sequence; identical to SEQ ID NO: 79
  synthetic construct

SEQ ID NO: 4621 - protein, 221 aa, Artificial Sequence; identical to SEQ ID NO: 80
  synthetic construct

SEQ ID NO: 4622 - protein, 222 aa, Artificial Sequence; identical to SEQ ID NO: 81
  synthetic construct

SEQ ID NO: 4623 - protein, 217 aa, Artificial Sequence; identical to SEQ ID NO: 82
  synthetic construct

SEQ ID NO: 4624 - protein, 221 aa, Artificial Sequence; identical to SEQ ID NO: 83
  synthetic construct

SEQ ID NO: 4625 - protein, 218 aa, Artificial Sequence; identical to SEQ ID NO: 84
  synthetic construct

SEQ ID NO: 4626 - protein, 219 aa, Artificial Sequence; identical to SEQ ID NO: 85
  synthetic construct

SEQ ID NO: 4627 - protein, 212 aa, Artificial Sequence; identical to SEQ ID NO: 86
  synthetic construct

SEQ ID NO: 4628 - protein, 120 aa, Artificial Sequence; identical to SEQ ID NO: 87
  synthetic construct

SEQ ID NO: 4629 - protein, 219 aa, Artificial Sequence; identical to SEQ ID NO: 88
  synthetic construct

SEQ ID NO: 4630 - protein, 228 aa, Artificial Sequence; identical to SEQ ID NO: 89
  synthetic construct

SEQ ID NO: 4631 - protein, 218 aa, Artificial Sequence; identical to SEQ ID NO: 90
  synthetic construct

SEQ ID NO: 4632 - protein, 226 aa, Artificial Sequence; identical to SEQ ID NO: 91
  synthetic construct

SEQ ID NO: 4633 - protein, 219 aa, Artificial Sequence; identical to SEQ ID NO: 92
  synthetic construct

SEQ ID NO: 4634 - protein, 222 aa, Artificial Sequence; identical to SEQ ID NO: 93
  synthetic construct

SEQ ID NO: 4635 - protein, 221 aa, Artificial Sequence; identical to SEQ ID NO: 94
  synthetic construct

SEQ ID NO: 4636 - protein, 226 aa, Artificial Sequence; identical to SEQ ID NO: 91
  synthetic construct

SEQ ID NO: 4637 - protein, 121 aa, Artificial Sequence; identical to SEQ ID NO: 96
  synthetic construct

SEQ ID NO: 4638 - protein, 222 aa, Artificial Sequence; identical to SEQ ID NO: 97
  synthetic construct

SEQ ID NO: 4639 - protein, 215 aa, Artificial Sequence; identical to SEQ ID NO: 98
  synthetic construct

SEQ ID NO: 4640 - protein, 221 aa, Artificial Sequence; identical to SEQ ID NO: 99
  synthetic construct

SEQ ID NO: 4641 - protein, 218 aa, Artificial Sequence; identical to SEQ ID NO: 100
  synthetic construct

SEQ ID NO: 4642 - protein, 218 aa, Artificial Sequence; identical to SEQ ID NO: 101
  synthetic construct

SEQ ID NO: 4643 - protein, 219 aa, Artificial Sequence; identical to SEQ ID NO: 102
  synthetic construct

SEQ ID NO: 4644 - protein, 218 aa, Artificial Sequence; identical to SEQ ID NO: 103
  synthetic construct

SEQ ID NO: 4645 - protein, 219 aa, Artificial Sequence; identical to SEQ ID NO: 104
  synthetic construct

SEQ ID NO: 4646 - protein, 123 aa, Artificial Sequence; identical to SEQ ID NO: 105
  synthetic construct

SEQ ID NO: 4647 - protein, 218 aa, Artificial Sequence; identical to SEQ ID NO: 106
  synthetic construct

SEQ ID NO: 4648 - protein, 225 aa, Artificial Sequence; identical to SEQ ID NO: 107
  synthetic construct

SEQ ID NO: 4649 - protein, 225 aa, Artificial Sequence; identical to SEQ ID NO: 108
  synthetic construct

SEQ ID NO: 4650 - protein, 218 aa, Artificial Sequence; identical to SEQ ID NO: 109
  synthetic construct

SEQ ID NO: 4651 - protein, 222 aa, Artificial Sequence; identical to SEQ ID NO: 110
  synthetic construct

SEQ ID NO: 4652 - protein, 116 aa, Artificial Sequence; identical to SEQ ID NO: 111
  synthetic construct

SEQ ID NO: 4653 - protein, 230 aa, Artificial Sequence; identical to SEQ ID NO: 112
  synthetic construct

SEQ ID NO: 4654 - protein, 223 aa, Artificial Sequence; identical to SEQ ID NO: 113
  synthetic construct

SEQ ID NO: 4655 - protein, 224 aa, Artificial Sequence; identical to SEQ ID NO: 114
  synthetic construct

SEQ ID NO: 4656 - protein, 215 aa, Artificial Sequence; identical to SEQ ID NO: 115
  synthetic construct

SEQ ID NO: 4657 - protein, 218 aa, Artificial Sequence; identical to SEQ ID NO: 116
  synthetic construct

SEQ ID NO: 4658 - protein, 222 aa, Artificial Sequence; identical to SEQ ID NO: 117
  synthetic construct

SEQ ID NO: 4659 - protein, 220 aa, Artificial Sequence; identical to SEQ ID NO: 118
  synthetic construct

SEQ ID NO: 4660 - protein, 125 aa, Artificial Sequence; identical to SEQ ID NO: 119
  synthetic construct

SEQ ID NO: 4661 - protein, 125 aa, Artificial Sequence; identical to SEQ ID NO: 120
  synthetic construct

SEQ ID NO: 4662 - protein, 214 aa, Artificial Sequence; identical to SEQ ID NO: 121
  synthetic construct

SEQ ID NO: 4663 - protein, 223 aa, Artificial Sequence; identical to SEQ ID NO: 122
  synthetic construct

SEQ ID NO: 4664 - protein, 219 aa, Artificial Sequence; identical to SEQ ID NO: 123
  synthetic construct

SEQ ID NO: 4665 - protein, 218 aa, Artificial Sequence; identical to SEQ ID NO: 124
  synthetic construct

SEQ ID NO: 4666 - protein, 218 aa, Artificial Sequence; identical to SEQ ID NO: 125
  synthetic construct

SEQ ID NO: 4667 - protein, 218 aa, Artificial Sequence; identical to SEQ ID NO: 126
  synthetic construct

SEQ ID NO: 4668 - protein, 220 aa, Artificial Sequence; identical to SEQ ID NO: 127
  synthetic construct

SEQ ID NO: 4669 - protein, 221 aa, Artificial Sequence; identical to SEQ ID NO: 128
  synthetic construct

SEQ ID NO: 4670 - protein, 216 aa, Artificial Sequence; identical to SEQ ID NO: 129
  synthetic construct

SEQ ID NO: 4671 - protein, 224 aa, Artificial Sequence; identical to SEQ ID NO: 130
  synthetic construct

SEQ ID NO: 4672 - protein, 116 aa, Artificial Sequence; identical to SEQ ID NO: 131
  synthetic construct

SEQ ID NO: 4673 - protein, 218 aa, Artificial Sequence; identical to SEQ ID NO: 132
  synthetic construct

SEQ ID NO: 4674 - protein, 222 aa, Artificial Sequence; identical to SEQ ID NO: 133
  synthetic construct

SEQ ID NO: 4675 - protein, 219 aa, Artificial Sequence; identical to SEQ ID NO: 134
  synthetic construct

SEQ ID NO: 4676 - protein, 223 aa, Artificial Sequence; identical to SEQ ID NO: 135
  synthetic construct

SEQ ID NO: 4677 - protein, 117 aa, Artificial Sequence; identical to SEQ ID NO: 136
  synthetic construct

SEQ ID NO: 4678 - protein, 221 aa, Artificial Sequence; identical to SEQ ID NO: 137
  synthetic construct

SEQ ID NO: 4679 - protein, 118 aa, Artificial Sequence; identical to SEQ ID NO: 138
  synthetic construct

SEQ ID NO: 4680 - protein, 121 aa, Artificial Sequence; identical to SEQ ID NO: 139
  synthetic construct

SEQ ID NO: 4681 - protein, 128 aa, Artificial Sequence; identical to SEQ ID NO: 140
  synthetic construct

SEQ ID NO: 4682 - protein, 216 aa, Artificial Sequence; identical to SEQ ID NO: 141
  synthetic construct

SEQ ID NO: 4683 - protein, 218 aa, Artificial Sequence; identical to SEQ ID NO: 142
  synthetic construct

SEQ ID NO: 4684 - protein, 219 aa, Artificial Sequence; identical to SEQ ID NO: 143
  synthetic construct

SEQ ID NO: 4685 - protein, 217 aa, Artificial Sequence; identical to SEQ ID NO: 144
  synthetic construct

SEQ ID NO: 4686 - protein, 224 aa, Artificial Sequence; identical to SEQ ID NO: 145
  synthetic construct

SEQ ID NO: 4687 - protein, 121 aa, Artificial Sequence; identical to SEQ ID NO: 146
  synthetic construct

SEQ ID NO: 4688 - protein, 214 aa, Artificial Sequence; identical to SEQ ID NO: 147
  synthetic construct

SEQ ID NO: 4689 - protein, 225 aa, Artificial Sequence; identical to SEQ ID NO: 148
  synthetic construct

SEQ ID NO: 4690 - protein, 120 aa, Artificial Sequence; identical to SEQ ID NO: 149
  synthetic construct

SEQ ID NO: 4691 - protein, 221 aa, Artificial Sequence; identical to SEQ ID NO: 150
  synthetic construct

SEQ ID NO: 4692 - protein, 217 aa, Artificial Sequence; identical to SEQ ID NO: 151
  synthetic construct

SEQ ID NO: 4693 - protein, 218 aa, Artificial Sequence; identical to SEQ ID NO: 152
  synthetic construct

SEQ ID NO: 4694 - protein, 217 aa, Artificial Sequence; identical to SEQ ID NO: 153
  synthetic construct

SEQ ID NO: 4695 - protein, 222 aa, Artificial Sequence; identical to SEQ ID NO: 154
  synthetic construct

SEQ ID NO: 4696 - protein, 213 aa, Artificial Sequence; identical to SEQ ID NO: 155
  synthetic construct

SEQ ID NO: 4697 - protein, 222 aa, Artificial Sequence; identical to SEQ ID NO: 156
  synthetic construct

SEQ ID NO: 4698 - protein, 227 aa, Artificial Sequence; identical to SEQ ID NO: 157
  synthetic construct

SEQ ID NO: 4699 - protein, 123 aa, Artificial Sequence; identical to SEQ ID NO: 158
  synthetic construct

SEQ ID NO: 4700 - protein, 214 aa, Artificial Sequence; identical to SEQ ID NO: 159
  synthetic construct

SEQ ID NO: 4701 - protein, 218 aa, Artificial Sequence; identical to SEQ ID NO: 160
  synthetic construct

SEQ ID NO: 4702 - protein, 219 aa, Artificial Sequence; identical to SEQ ID NO: 161
  synthetic construct

SEQ ID NO: 4703 - protein, 223 aa, Artificial Sequence; identical to SEQ ID NO: 162
  synthetic construct

SEQ ID NO: 4704 - protein, 217 aa, Artificial Sequence; identical to SEQ ID NO: 163
  synthetic construct

SEQ ID NO: 4705 - protein, 220 aa, Artificial Sequence; identical to SEQ ID NO: 164
  synthetic construct

SEQ ID NO: 4706 - protein, 231 aa, Artificial Sequence; identical to SEQ ID NO: 165
  synthetic construct

SEQ ID NO: 4707 - protein, 222 aa, Artificial Sequence; identical to SEQ ID NO: 166
  synthetic construct

SEQ ID NO: 4708 - protein, 222 aa, Artificial Sequence; identical to SEQ ID NO: 167
  synthetic construct

SEQ ID NO: 4709 - protein, 224 aa, Artificial Sequence; identical to SEQ ID NO: 168
  synthetic construct

SEQ ID NO: 4710 - protein, 219 aa, Artificial Sequence; identical to SEQ ID NO: 169
  synthetic construct

SEQ ID NO: 4711 - protein, 224 aa, Artificial Sequence; identical to SEQ ID NO: 170
  synthetic construct

SEQ ID NO: 4712 - protein, 217 aa, Artificial Sequence; identical to SEQ ID NO: 171
  synthetic construct

SEQ ID NO: 4713 - protein, 224 aa, Artificial Sequence; identical to SEQ ID NO: 172
  synthetic construct

SEQ ID NO: 4714 - protein, 217 aa, Artificial Sequence; identical to SEQ ID NO: 173
  synthetic construct

SEQ ID NO: 4715 - protein, 226 aa, Artificial Sequence; identical to SEQ ID NO: 174
  synthetic construct

SEQ ID NO: 4716 - protein, 220 aa, Artificial Sequence; identical to SEQ ID NO: 175
  synthetic construct

SEQ ID NO: 4717 - protein, 220 aa, Artificial Sequence; identical to SEQ ID NO: 176
  synthetic construct

SEQ ID NO: 4718 - protein, 224 aa, Artificial Sequence; identical to SEQ ID NO: 177
  synthetic construct

SEQ ID NO: 4719 - protein, 222 aa, Artificial Sequence; identical to SEQ ID NO: 178
  synthetic construct

SEQ ID NO: 4720 - protein, 223 aa, Artificial Sequence; identical to SEQ ID NO: 179
  synthetic construct

SEQ ID NO: 4721 - protein, 217 aa, Artificial Sequence; identical to SEQ ID NO: 180
  synthetic construct

SEQ ID NO: 4722 - protein, 220 aa, Artificial Sequence; identical to SEQ ID NO: 181
  synthetic construct

SEQ ID NO: 4723 - protein, 219 aa, Artificial Sequence; identical to SEQ ID NO: 182
  synthetic construct

SEQ ID NO: 4724 - protein, 219 aa, Artificial Sequence; identical to SEQ ID NO: 183
  synthetic construct

SEQ ID NO: 4725 - protein, 217 aa, Artificial Sequence; identical to SEQ ID NO: 184
  synthetic construct

SEQ ID NO: 4726 - protein, 217 aa, Artificial Sequence; identical to SEQ ID NO: 185
  synthetic construct

SEQ ID NO: 4727 - protein, 215 aa, Artificial Sequence; identical to SEQ ID NO: 186
  synthetic construct

SEQ ID NO: 4728 - protein, 221 aa, Artificial Sequence; identical to SEQ ID NO: 187
  synthetic construct

SEQ ID NO: 4729 - protein, 220 aa, Artificial Sequence; identical to SEQ ID NO: 188
  synthetic construct

SEQ ID NO: 4730 - protein, 219 aa, Artificial Sequence; identical to SEQ ID NO: 189
  synthetic construct

SEQ ID NO: 4731 - protein, 217 aa, Artificial Sequence; identical to SEQ ID NO: 190
  synthetic construct

SEQ ID NO: 4732 - protein, 229 aa, Artificial Sequence; identical to SEQ ID NO: 191
  synthetic construct

SEQ ID NO: 4733 - protein, 217 aa, Artificial Sequence; identical to SEQ ID NO: 192
  synthetic construct

SEQ ID NO: 4734 - protein, 220 aa, Artificial Sequence; identical to SEQ ID NO: 193
  synthetic construct

SEQ ID NO: 4735 - protein, 216 aa, Artificial Sequence; identical to SEQ ID NO: 194
  synthetic construct

SEQ ID NO: 4736 - protein, 116 aa, Artificial Sequence; identical to SEQ ID NO: 195
  synthetic construct

SEQ ID NO: 4737 - protein, 223 aa, Artificial Sequence; identical to SEQ ID NO: 196
  synthetic construct

SEQ ID NO: 4738 - protein, 117 aa, Artificial Sequence; identical to SEQ ID NO: 197
  synthetic construct

SEQ ID NO: 4739 - protein, 117 aa, Artificial Sequence; identical to SEQ ID NO: 198
  synthetic construct

SEQ ID NO: 4740 - protein, 223 aa, Artificial Sequence; identical to SEQ ID NO: 199
  synthetic construct

SEQ ID NO: 4741 - protein, 121 aa, Artificial Sequence; identical to SEQ ID NO: 200
  synthetic construct

SEQ ID NO: 4742 - protein, 115 aa, Artificial Sequence; identical to SEQ ID NO: 201
  synthetic construct

SEQ ID NO: 4743 - protein, 216 aa, Artificial Sequence; identical to SEQ ID NO: 202
  synthetic construct

SEQ ID NO: 4744 - protein, 219 aa, Artificial Sequence; identical to SEQ ID NO: 203
  synthetic construct

SEQ ID NO: 4745 - protein, 225 aa, Artificial Sequence; identical to SEQ ID NO: 204
  synthetic construct

SEQ ID NO: 4746 - protein, 223 aa, Artificial Sequence; identical to SEQ ID NO: 205
  synthetic construct

SEQ ID NO: 4747 - protein, 223 aa, Artificial Sequence; identical to SEQ ID NO: 206
  synthetic construct

SEQ ID NO: 4748 - protein, 223 aa, Artificial Sequence; identical to SEQ ID NO: 207
  synthetic construct

SEQ ID NO: 4749 - protein, 224 aa, Artificial Sequence; identical to SEQ ID NO: 208
  synthetic construct

SEQ ID NO: 4750 - protein, 226 aa, Artificial Sequence; identical to SEQ ID NO: 209
  synthetic construct

SEQ ID NO: 4751 - protein, 217 aa, Artificial Sequence; identical to SEQ ID NO: 210
  synthetic construct

SEQ ID NO: 4752 - protein, 218 aa, Artificial Sequence; identical to SEQ ID NO: 211
  synthetic construct

SEQ ID NO: 4753 - protein, 219 aa, Artificial Sequence; identical to SEQ ID NO: 212
  synthetic construct

SEQ ID NO: 4754 - protein, 226 aa, Artificial Sequence; identical to SEQ ID NO: 213
  synthetic construct

SEQ ID NO: 4755 - protein, 224 aa, Artificial Sequence; identical to SEQ ID NO: 214
  synthetic construct

SEQ ID NO: 4756 - protein, 223 aa, Artificial Sequence; identical to SEQ ID NO: 215
  synthetic construct

SEQ ID NO: 4757 - protein, 216 aa, Artificial Sequence; identical to SEQ ID NO: 216
  synthetic construct

SEQ ID NO: 4758 - protein, 220 aa, Artificial Sequence; identical to SEQ ID NO: 217
  synthetic construct

SEQ ID NO: 4759 - protein, 120 aa, Artificial Sequence; identical to SEQ ID NO: 218
  synthetic construct

SEQ ID NO: 4760 - protein, 121 aa, Artificial Sequence; identical to SEQ ID NO: 219
  synthetic construct

SEQ ID NO: 4761 - protein, 223 aa, Artificial Sequence; identical to SEQ ID NO: 220
  synthetic construct

SEQ ID NO: 4762 - protein, 226 aa, Artificial Sequence; identical to SEQ ID NO: 221
  synthetic construct

SEQ ID NO: 4763 - protein, 119 aa, Artificial Sequence; identical to SEQ ID NO: 222
  synthetic construct

SEQ ID NO: 4764 - protein, 117 aa, Artificial Sequence; identical to SEQ ID NO: 223
  synthetic construct

SEQ ID NO: 4765 - protein, 219 aa, Artificial Sequence; identical to SEQ ID NO: 224
  synthetic construct

SEQ ID NO: 4766 - protein, 120 aa, Artificial Sequence; identical to SEQ ID NO: 225
  synthetic construct

SEQ ID NO: 4767 - protein, 117 aa, Artificial Sequence; identical to SEQ ID NO: 226
  synthetic construct

SEQ ID NO: 4768 - protein, 221 aa, Artificial Sequence; identical to SEQ ID NO: 227
  synthetic construct

SEQ ID NO: 4769 - protein, 117 aa, Artificial Sequence; identical to SEQ ID NO: 228
  synthetic construct

SEQ ID NO: 4770 - protein, 221 aa, Artificial Sequence; identical to SEQ ID NO: 229
  synthetic construct

SEQ ID NO: 4771 - protein, 227 aa, Artificial Sequence; identical to SEQ ID NO: 230
  synthetic construct

SEQ ID NO: 4772 - protein, 218 aa, Artificial Sequence; identical to SEQ ID NO: 231
  synthetic construct

SEQ ID NO: 4773 - protein, 215 aa, Artificial Sequence; identical to SEQ ID NO: 232
  synthetic construct

SEQ ID NO: 4774 - protein, 219 aa, Artificial Sequence; identical to SEQ ID NO: 233
  synthetic construct

SEQ ID NO: 4775 - protein, 123 aa, Artificial Sequence; identical to SEQ ID NO: 234
  synthetic construct

SEQ ID NO: 4776 - protein, 224 aa, Artificial Sequence; identical to SEQ ID NO: 235
  synthetic construct

SEQ ID NO: 4777 - protein, 220 aa, Artificial Sequence; identical to SEQ ID NO: 236
  synthetic construct

SEQ ID NO: 4778 - protein, 219 aa, Artificial Sequence; identical to SEQ ID NO: 237
  synthetic construct

SEQ ID NO: 4779 - protein, 219 aa, Artificial Sequence; identical to SEQ ID NO: 238
  synthetic construct

SEQ ID NO: 4780 - protein, 221 aa, Artificial Sequence; identical to SEQ ID NO: 239
  synthetic construct

SEQ ID NO: 4781 - protein, 218 aa, Artificial Sequence; identical to SEQ ID NO: 240
  synthetic construct

SEQ ID NO: 4782 - protein, 219 aa, Artificial Sequence; identical to SEQ ID NO: 241
  synthetic construct

SEQ ID NO: 4783 - protein, 120 aa, Artificial Sequence; identical to SEQ ID NO: 242
  synthetic construct

SEQ ID NO: 4784 - protein, 218 aa, Artificial Sequence; identical to SEQ ID NO: 243
  synthetic construct

SEQ ID NO: 4785 - protein, 219 aa, Artificial Sequence; identical to SEQ ID NO: 244
  synthetic construct

SEQ ID NO: 4786 - protein, 221 aa, Artificial Sequence; identical to SEQ ID NO: 245
  synthetic construct

SEQ ID NO: 4787 - protein, 116 aa, Artificial Sequence; identical to SEQ ID NO: 246
  synthetic construct

SEQ ID NO: 4788 - protein, 223 aa, Artificial Sequence; identical to SEQ ID NO: 247
  synthetic construct

SEQ ID NO: 4789 - protein, 217 aa, Artificial Sequence; identical to SEQ ID NO: 248
  synthetic construct

SEQ ID NO: 4790 - protein, 219 aa, Artificial Sequence; identical to SEQ ID NO: 249
  synthetic construct

SEQ ID NO: 4791 - protein, 216 aa, Artificial Sequence; identical to SEQ ID NO: 250
  synthetic construct

SEQ ID NO: 4792 - protein, 226 aa, Artificial Sequence; identical to SEQ ID NO: 251
  synthetic construct

SEQ ID NO: 4793 - protein, 218 aa, Artificial Sequence; identical to SEQ ID NO: 252
  synthetic construct

SEQ ID NO: 4794 - protein, 125 aa, Artificial Sequence; identical to SEQ ID NO: 253
  synthetic construct

SEQ ID NO: 4795 - protein, 113 aa, Artificial Sequence; identical to SEQ ID NO: 254
  synthetic construct

SEQ ID NO: 4796 - protein, 226 aa, Artificial Sequence; identical to SEQ ID NO: 255
  synthetic construct

SEQ ID NO: 4797 - protein, 219 aa, Artificial Sequence; identical to SEQ ID NO: 256
  synthetic construct

SEQ ID NO: 4798 - protein, 216 aa, Artificial Sequence; identical to SEQ ID NO: 257
  synthetic construct

SEQ ID NO: 4799 - protein, 121 aa, Artificial Sequence; identical to SEQ ID NO: 258
  synthetic construct

SEQ ID NO: 4800 - protein, 216 aa, Artificial Sequence; identical to SEQ ID NO: 259
  synthetic construct

SEQ ID NO: 4801 - protein, 220 aa, Artificial Sequence; identical to SEQ ID NO: 260
  synthetic construct

SEQ ID NO: 4802 - protein, 213 aa, Artificial Sequence; identical to SEQ ID NO: 261
  synthetic construct

SEQ ID NO: 4803 - protein, 217 aa, Artificial Sequence; identical to SEQ ID NO: 262
  synthetic construct

SEQ ID NO: 4804 - protein, 217 aa, Artificial Sequence; identical to SEQ ID NO: 263
  synthetic construct

SEQ ID NO: 4805 - protein, 225 aa, Artificial Sequence; identical to SEQ ID NO: 264
  synthetic construct

SEQ ID NO: 4806 - protein, 211 aa, Artificial Sequence; identical to SEQ ID NO: 265
  synthetic construct

SEQ ID NO: 4807 - protein, 219 aa, Artificial Sequence; identical to SEQ ID NO: 266
  synthetic construct

SEQ ID NO: 4808 - protein, 224 aa, Artificial Sequence; identical to SEQ ID NO: 267
  synthetic construct

SEQ ID NO: 4809 - protein, 221 aa, Artificial Sequence; identical to SEQ ID NO: 268
  synthetic construct

SEQ ID NO: 4810 - protein, 222 aa, Artificial Sequence; identical to SEQ ID NO: 269
  synthetic construct

SEQ ID NO: 4811 - protein, 222 aa, Artificial Sequence; identical to SEQ ID NO: 270
  synthetic construct

SEQ ID NO: 4812 - protein, 218 aa, Artificial Sequence; identical to SEQ ID NO: 271
  synthetic construct

SEQ ID NO: 4813 - protein, 214 aa, Artificial Sequence; identical to SEQ ID NO: 272
  synthetic construct

SEQ ID NO: 4814 - protein, 214 aa, Artificial Sequence; identical to SEQ ID NO: 273
  synthetic construct

SEQ ID NO: 4815 - protein, 214 aa, Artificial Sequence; identical to SEQ ID NO: 274
  synthetic construct

SEQ ID NO: 4816 - protein, 110 aa, Artificial Sequence; identical to SEQ ID NO: 275
  synthetic construct

SEQ ID NO: 4817 - protein, 212 aa, Artificial Sequence; identical to SEQ ID NO: 276
  synthetic construct

SEQ ID NO: 4818 - protein, 214 aa, Artificial Sequence; identical to SEQ ID NO: 277
  synthetic construct

SEQ ID NO: 4819 - protein, 106 aa, Artificial Sequence; identical to SEQ ID NO: 278
  synthetic construct

SEQ ID NO: 4820 - protein, 216 aa, Artificial Sequence; identical to SEQ ID NO: 279
  synthetic construct

SEQ ID NO: 4821 - protein, 110 aa, Artificial Sequence; identical to SEQ ID NO: 280
  synthetic construct

SEQ ID NO: 4822 - protein, 215 aa, Artificial Sequence; identical to SEQ ID NO: 281
  synthetic construct

SEQ ID NO: 4823 - protein, 215 aa, Artificial Sequence; identical to SEQ ID NO: 282
  synthetic construct

SEQ ID NO: 4824 - protein, 112 aa, Artificial Sequence; identical to SEQ ID NO: 283
  synthetic construct

SEQ ID NO: 4825 - protein, 216 aa, Artificial Sequence; identical to SEQ ID NO: 284
  synthetic construct

SEQ ID NO: 4826 - protein, 216 aa, Artificial Sequence; identical to SEQ ID NO: 285
  synthetic construct

SEQ ID NO: 4827 - protein, 213 aa, Artificial Sequence; identical to SEQ ID NO: 286
  synthetic construct

SEQ ID NO: 4828 - protein, 215 aa, Artificial Sequence; identical to SEQ ID NO: 287
  synthetic construct

SEQ ID NO: 4829 - protein, 212 aa, Artificial Sequence
  synthetic construct
PYELTQPPSVSVSPGQTARITCSGDALPKQYAYWYQQKPGQAPVLVIYKDSERPSGIPERFSGSSSGTTVTLTISGVQAEDEADYYCQSADSSDTYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 4830 - protein, 214 aa, Artificial Sequence; identical to SEQ ID NO: 289
  synthetic construct

SEQ ID NO: 4831 - protein, 215 aa, Artificial Sequence; identical to SEQ ID NO: 290
  synthetic construct

SEQ ID NO: 4832 - protein, 213 aa, Artificial Sequence; identical to SEQ ID NO: 291
  synthetic construct

SEQ ID NO: 4833 - protein, 220 aa, Artificial Sequence; identical to SEQ ID NO: 292
  synthetic construct

SEQ ID NO: 4834 - protein, 106 aa, Artificial Sequence; identical to SEQ ID NO: 293
  synthetic construct

SEQ ID NO: 4835 - protein, 217 aa, Artificial Sequence; identical to SEQ ID NO: 294
  synthetic construct

SEQ ID NO: 4836 - protein, 216 aa, Artificial Sequence; identical to SEQ ID NO: 295
  synthetic construct

SEQ ID NO: 4837 - protein, 214 aa, Artificial Sequence; identical to SEQ ID NO: 296
  synthetic construct

SEQ ID NO: 4838 - protein, 214 aa, Artificial Sequence; identical to SEQ ID NO: 297
  synthetic construct

SEQ ID NO: 4839 - protein, 217 aa, Artificial Sequence; identical to SEQ ID NO: 298
  synthetic construct

SEQ ID NO: 4840 - protein, 108 aa, Artificial Sequence; identical to SEQ ID NO: 299
  synthetic construct

SEQ ID NO: 4841 - protein, 214 aa, Artificial Sequence; identical to SEQ ID NO: 300
  synthetic construct

SEQ ID NO: 4842 - protein, 213 aa, Artificial Sequence; identical to SEQ ID NO: 301
  synthetic construct

SEQ ID NO: 4843 - protein, 217 aa, Artificial Sequence; identical to SEQ ID NO: 302
  synthetic construct

SEQ ID NO: 4844 - protein, 216 aa, Artificial Sequence; identical to SEQ ID NO: 303
  synthetic construct

SEQ ID NO: 4845 - protein, 219 aa, Artificial Sequence; identical to SEQ ID NO: 304
  synthetic construct

SEQ ID NO: 4846 - protein, 108 aa, Artificial Sequence; identical to SEQ ID NO: 305
  synthetic construct

SEQ ID NO: 4847 - protein, 217 aa, Artificial Sequence; identical to SEQ ID NO: 306
  synthetic construct

SEQ ID NO: 4848 - protein, 214 aa, Artificial Sequence; identical to SEQ ID NO: 307
  synthetic construct

SEQ ID NO: 4849 - protein, 220 aa, Artificial Sequence; identical to SEQ ID NO: 308
  synthetic construct

SEQ ID NO: 4850 - protein, 219 aa, Artificial Sequence; identical to SEQ ID NO: 309
  synthetic construct

SEQ ID NO: 4851 - protein, 216 aa, Artificial Sequence; identical to SEQ ID NO: 310
  synthetic construct

SEQ ID NO: 4852 - protein, 214 aa, Artificial Sequence; identical to SEQ ID NO: 311
  synthetic construct

SEQ ID NO: 4853 - protein, 214 aa, Artificial Sequence; identical to SEQ ID NO: 312
  synthetic construct

SEQ ID NO: 4854 - protein, 216 aa, Artificial Sequence; identical to SEQ ID NO: 313
  synthetic construct

SEQ ID NO: 4855 - protein, 214 aa, Artificial Sequence; identical to SEQ ID NO: 314
  synthetic construct

SEQ ID NO: 4856 - protein, 108 aa, Artificial Sequence; identical to SEQ ID NO: 315
  synthetic construct

SEQ ID NO: 4857 - protein, 109 aa, Artificial Sequence; identical to SEQ ID NO: 316
  synthetic construct

SEQ ID NO: 4858 - protein, 214 aa, Artificial Sequence; identical to SEQ ID NO: 317
  synthetic construct

SEQ ID NO: 4859 - protein, 215 aa, Artificial Sequence; identical to SEQ ID NO: 318
  synthetic construct

SEQ ID NO: 4860 - protein, 216 aa, Artificial Sequence; identical to SEQ ID NO: 319
  synthetic construct

SEQ ID NO: 4861 - protein, 214 aa, Artificial Sequence; identical to SEQ ID NO: 320
  synthetic construct

SEQ ID NO: 4862 - protein, 215 aa, Artificial Sequence; identical to SEQ ID NO: 321
  synthetic construct

SEQ ID NO: 4863 - protein, 214 aa, Artificial Sequence; identical to SEQ ID NO: 322
  synthetic construct

SEQ ID NO: 4864 - protein, 215 aa, Artificial Sequence; identical to SEQ ID NO: 323
  synthetic construct

SEQ ID NO: 4865 - protein, 108 aa, Artificial Sequence; identical to SEQ ID NO: 324
  synthetic construct

SEQ ID NO: 4866 - protein, 219 aa, Artificial Sequence; identical to SEQ ID NO: 325
  synthetic construct

SEQ ID NO: 4867 - protein, 213 aa, Artificial Sequence; identical to SEQ ID NO: 326
  synthetic construct

SEQ ID NO: 4868 - protein, 110 aa, Artificial Sequence; identical to SEQ ID NO: 327
  synthetic construct

SEQ ID NO: 4869 - protein, 216 aa, Artificial Sequence; identical to SEQ ID NO: 328
  synthetic construct

SEQ ID NO: 4870 - protein, 215 aa, Artificial Sequence; identical to SEQ ID NO: 329
  synthetic construct

SEQ ID NO: 4871 - protein, 214 aa, Artificial Sequence; identical to SEQ ID NO: 330
  synthetic construct

SEQ ID NO: 4872 - protein, 214 aa, Artificial Sequence; identical to SEQ ID NO: 331
  synthetic construct

SEQ ID NO: 4873 - protein, 215 aa, Artificial Sequence; identical to SEQ ID NO: 332
  synthetic construct

SEQ ID NO: 4874 - protein, 214 aa, Artificial Sequence; identical to SEQ ID NO: 333
  synthetic construct

SEQ ID NO: 4875 - protein, 219 aa, Artificial Sequence; identical to SEQ ID NO: 334
  synthetic construct

SEQ ID NO: 4876 - protein, 217 aa, Artificial Sequence; identical to SEQ ID NO: 335
  synthetic construct

SEQ ID NO: 4877 - protein, 215 aa, Artificial Sequence; identical to SEQ ID NO: 336
  synthetic construct

SEQ ID NO: 4878 - protein, 216 aa, Artificial Sequence; identical to SEQ ID NO: 337
  synthetic construct

SEQ ID NO: 4879 - protein, 219 aa, Artificial Sequence; identical to SEQ ID NO: 338
  synthetic construct

SEQ ID NO: 4880 - protein, 216 aa, Artificial Sequence; identical to SEQ ID NO: 339
  synthetic construct

SEQ ID NO: 4881 - protein, 215 aa, Artificial Sequence; identical to SEQ ID NO: 340
  synthetic construct

SEQ ID NO: 4882 - protein, 216 aa, Artificial Sequence; identical to SEQ ID NO: 341
  synthetic construct

SEQ ID NO: 4883 - protein, 214 aa, Artificial Sequence; identical to SEQ ID NO: 342
  synthetic construct

SEQ ID NO: 4884 - protein, 216 aa, Artificial Sequence; identical to SEQ ID NO: 343
  synthetic construct

SEQ ID NO: 4885 - protein, 107 aa, Artificial Sequence; identical to SEQ ID NO: 344
  synthetic construct

SEQ ID NO: 4886 - protein, 215 aa, Artificial Sequence; identical to SEQ ID NO: 345
  synthetic construct

SEQ ID NO: 4887 - protein, 214 aa, Artificial Sequence; identical to SEQ ID NO: 346
  synthetic construct

SEQ ID NO: 4888 - protein, 217 aa, Artificial Sequence; identical to SEQ ID NO: 347
  synthetic construct

SEQ ID NO: 4889 - protein, 217 aa, Artificial Sequence; identical to SEQ ID NO: 348
  synthetic construct

SEQ ID NO: 4890 - protein, 213 aa, Artificial Sequence; identical to SEQ ID NO: 349
  synthetic construct

SEQ ID NO: 4891 - protein, 221 aa, Artificial Sequence; identical to SEQ ID NO: 350
  synthetic construct

SEQ ID NO: 4892 - protein, 214 aa, Artificial Sequence; identical to SEQ ID NO: 351
  synthetic construct

SEQ ID NO: 4893 - protein, 214 aa, Artificial Sequence; identical to SEQ ID NO: 352
  synthetic construct

SEQ ID NO: 4894 - protein, 217 aa, Artificial Sequence; identical to SEQ ID NO: 353
  synthetic construct

SEQ ID NO: 4895 - protein, 214 aa, Artificial Sequence; identical to SEQ ID NO: 354
  synthetic construct

SEQ ID NO: 4896 - protein, 214 aa, Artificial Sequence; identical to SEQ ID NO: 355
  synthetic construct

SEQ ID NO: 4897 - protein, 217 aa, Artificial Sequence; identical to SEQ ID NO: 356
  synthetic construct

SEQ ID NO: 4898 - protein, 220 aa, Artificial Sequence; identical to SEQ ID NO: 357
  synthetic construct

SEQ ID NO: 4899 - protein, 106 aa, Artificial Sequence; identical to SEQ ID NO: 358
  synthetic construct

SEQ ID NO: 4900 - protein, 212 aa, Artificial Sequence; identical to SEQ ID NO: 359
  synthetic construct

SEQ ID NO: 4901 - protein, 220 aa, Artificial Sequence; identical to SEQ ID NO: 360
  synthetic construct

SEQ ID NO: 4902 - protein, 216 aa, Artificial Sequence; identical to SEQ ID NO: 361
  synthetic construct

SEQ ID NO: 4903 - protein, 215 aa, Artificial Sequence; identical to SEQ ID NO: 362
  synthetic construct

SEQ ID NO: 4904 - protein, 219 aa, Artificial Sequence; identical to SEQ ID NO: 363
  synthetic construct

SEQ ID NO: 4905 - protein, 214 aa, Artificial Sequence; identical to SEQ ID NO: 364
  synthetic construct

SEQ ID NO: 4906 - protein, 216 aa, Artificial Sequence; identical to SEQ ID NO: 365
  synthetic construct

SEQ ID NO: 4907 - protein, 215 aa, Artificial Sequence; identical to SEQ ID NO: 362
  synthetic construct

SEQ ID NO: 4908 - protein, 112 aa, Artificial Sequence; identical to SEQ ID NO: 367
  synthetic construct

SEQ ID NO: 4909 - protein, 216 aa, Artificial Sequence; identical to SEQ ID NO: 368
  synthetic construct

SEQ ID NO: 4910 - protein, 220 aa, Artificial Sequence; identical to SEQ ID NO: 369
  synthetic construct

SEQ ID NO: 4911 - protein, 214 aa, Artificial Sequence; identical to SEQ ID NO: 370
  synthetic construct

SEQ ID NO: 4912 - protein, 214 aa, Artificial Sequence; identical to SEQ ID NO: 371
  synthetic construct

SEQ ID NO: 4913 - protein, 214 aa, Artificial Sequence; identical to SEQ ID NO: 372
  synthetic construct

SEQ ID NO: 4914 - protein, 215 aa, Artificial Sequence; identical to SEQ ID NO: 373
  synthetic construct

SEQ ID NO: 4915 - protein, 214 aa, Artificial Sequence; identical to SEQ ID NO: 374
  synthetic construct

SEQ ID NO: 4916 - protein, 215 aa, Artificial Sequence; identical to SEQ ID NO: 375
  synthetic construct

SEQ ID NO: 4917 - protein, 112 aa, Artificial Sequence; identical to SEQ ID NO: 376
  synthetic construct

SEQ ID NO: 4918 - protein, 215 aa, Artificial Sequence; identical to SEQ ID NO: 377
  synthetic construct

SEQ ID NO: 4919 - protein, 217 aa, Artificial Sequence; identical to SEQ ID NO: 378
  synthetic construct

SEQ ID NO: 4920 - protein, 216 aa, Artificial Sequence; identical to SEQ ID NO: 379
  synthetic construct

SEQ ID NO: 4921 - protein, 215 aa, Artificial Sequence; identical to SEQ ID NO: 380
  synthetic construct

SEQ ID NO: 4922 - protein, 220 aa, Artificial Sequence; identical to SEQ ID NO: 381
  synthetic construct

SEQ ID NO: 4923 - protein, 108 aa, Artificial Sequence; identical to SEQ ID NO: 382
  synthetic construct

SEQ ID NO: 4924 - protein, 216 aa, Artificial Sequence; identical to SEQ ID NO: 383
  synthetic construct

SEQ ID NO: 4925 - protein, 214 aa, Artificial Sequence; identical to SEQ ID NO: 384
  synthetic construct

SEQ ID NO: 4926 - protein, 215 aa, Artificial Sequence; identical to SEQ ID NO: 385
  synthetic construct

SEQ ID NO: 4927 - protein, 217 aa, Artificial Sequence; identical to SEQ ID NO: 386
  synthetic construct

SEQ ID NO: 4928 - protein, 216 aa, Artificial Sequence; identical to SEQ ID NO: 387
  synthetic construct

SEQ ID NO: 4929 - protein, 218 aa, Artificial Sequence; identical to SEQ ID NO: 388
  synthetic construct

SEQ ID NO: 4930 - protein, 215 aa, Artificial Sequence; identical to SEQ ID NO: 389
  synthetic construct

SEQ ID NO: 4931 - protein, 110 aa, Artificial Sequence; identical to SEQ ID NO: 390
  synthetic construct

SEQ ID NO: 4932 - protein, 107 aa, Artificial Sequence; identical to SEQ ID NO: 391
  synthetic construct

SEQ ID NO: 4933 - protein, 214 aa, Artificial Sequence; identical to SEQ ID NO: 392
  synthetic construct

SEQ ID NO: 4934 - protein, 214 aa, Artificial Sequence; identical to SEQ ID NO: 393
  synthetic construct

SEQ ID NO: 4935 - protein, 215 aa, Artificial Sequence; identical to SEQ ID NO: 394
  synthetic construct

SEQ ID NO: 4936 - protein, 214 aa, Artificial Sequence; identical to SEQ ID NO: 395
  synthetic construct

SEQ ID NO: 4937 - protein, 215 aa, Artificial Sequence; identical to SEQ ID NO: 396
  synthetic construct

SEQ ID NO: 4938 - protein, 216 aa, Artificial Sequence; identical to SEQ ID NO: 397
  synthetic construct

SEQ ID NO: 4939 - protein, 214 aa, Artificial Sequence; identical to SEQ ID NO: 398
  synthetic construct

SEQ ID NO: 4940 - protein, 216 aa, Artificial Sequence; identical to SEQ ID NO: 399
  synthetic construct

SEQ ID NO: 4941 - protein, 216 aa, Artificial Sequence; identical to SEQ ID NO: 400
  synthetic construct

SEQ ID NO: 4942 - protein, 212 aa, Artificial Sequence; identical to SEQ ID NO: 401
  synthetic construct

SEQ ID NO: 4943 - protein, 108 aa, Artificial Sequence; identical to SEQ ID NO: 402
  synthetic construct

SEQ ID NO: 4944 - protein, 214 aa, Artificial Sequence; identical to SEQ ID NO: 403
  synthetic construct

SEQ ID NO: 4945 - protein, 212 aa, Artificial Sequence; identical to SEQ ID NO: 404
  synthetic construct

SEQ ID NO: 4946 - protein, 213 aa, Artificial Sequence; identical to SEQ ID NO: 405
  synthetic construct

SEQ ID NO: 4947 - protein, 214 aa, Artificial Sequence; identical to SEQ ID NO: 406
  synthetic construct

SEQ ID NO: 4948 - protein, 107 aa, Artificial Sequence; identical to SEQ ID NO: 407
  synthetic construct

SEQ ID NO: 4949 - protein, 214 aa, Artificial Sequence; identical to SEQ ID NO: 408
  synthetic construct

SEQ ID NO: 4950 - protein, 110 aa, Artificial Sequence; identical to SEQ ID NO: 409
  synthetic construct

SEQ ID NO: 4951 - protein, 105 aa, Artificial Sequence; identical to SEQ ID NO: 410
  synthetic construct

SEQ ID NO: 4952 - protein, 110 aa, Artificial Sequence; identical to SEQ ID NO: 411
  synthetic construct

SEQ ID NO: 4953 - protein, 214 aa, Artificial Sequence; identical to SEQ ID NO: 412
  synthetic construct

SEQ ID NO: 4954 - protein, 215 aa, Artificial Sequence; identical to SEQ ID NO: 413
  synthetic construct

SEQ ID NO: 4955 - protein, 216 aa, Artificial Sequence; identical to SEQ ID NO: 414
  synthetic construct

SEQ ID NO: 4956 - protein, 214 aa, Artificial Sequence; identical to SEQ ID NO: 415
  synthetic construct

SEQ ID NO: 4957 - protein, 214 aa, Artificial Sequence; identical to SEQ ID NO: 416
  synthetic construct

SEQ ID NO: 4958 - protein, 106 aa, Artificial Sequence; identical to SEQ ID NO: 417
  synthetic construct

SEQ ID NO: 4959 - protein, 216 aa, Artificial Sequence; identical to SEQ ID NO: 418
  synthetic construct

SEQ ID NO: 4960 - protein, 215 aa, Artificial Sequence; identical to SEQ ID NO: 419
  synthetic construct

SEQ ID NO: 4961 - protein, 113 aa, Artificial Sequence; identical to SEQ ID NO: 420
  synthetic construct

SEQ ID NO: 4962 - protein, 216 aa, Artificial Sequence; identical to SEQ ID NO: 421
  synthetic construct

SEQ ID NO: 4963 - protein, 216 aa, Artificial Sequence; identical to SEQ ID NO: 422
  synthetic construct

SEQ ID NO: 4964 - protein, 214 aa, Artificial Sequence; identical to SEQ ID NO: 423
  synthetic construct

SEQ ID NO: 4965 - protein, 214 aa, Artificial Sequence; identical to SEQ ID NO: 424
  synthetic construct

SEQ ID NO: 4966 - protein, 216 aa, Artificial Sequence; identical to SEQ ID NO: 425
  synthetic construct

SEQ ID NO: 4967 - protein, 215 aa, Artificial Sequence; identical to SEQ ID NO: 426
  synthetic construct

SEQ ID NO: 4968 - protein, 217 aa, Artificial Sequence; identical to SEQ ID NO: 427
  synthetic construct

SEQ ID NO: 4969 - protein, 217 aa, Artificial Sequence; identical to SEQ ID NO: 428
  synthetic construct

SEQ ID NO: 4970 - protein, 112 aa, Artificial Sequence; identical to SEQ ID NO: 429
  synthetic construct

SEQ ID NO: 4971 - protein, 214 aa, Artificial Sequence; identical to SEQ ID NO: 430
  synthetic construct

SEQ ID NO: 4972 - protein, 216 aa, Artificial Sequence; identical to SEQ ID NO: 431
  synthetic construct

SEQ ID NO: 4973 - protein, 219 aa, Artificial Sequence; identical to SEQ ID NO: 432
  synthetic construct

SEQ ID NO: 4974 - protein, 216 aa, Artificial Sequence; identical to SEQ ID NO: 433
  synthetic construct

SEQ ID NO: 4975 - protein, 214 aa, Artificial Sequence; identical to SEQ ID NO: 434
  synthetic construct

SEQ ID NO: 4976 - protein, 220 aa, Artificial Sequence; identical to SEQ ID NO: 435
  synthetic construct

SEQ ID NO: 4977 - protein, 217 aa, Artificial Sequence; identical to SEQ ID NO: 436
  synthetic construct

SEQ ID NO: 4978 - protein, 213 aa, Artificial Sequence; identical to SEQ ID NO: 437
  synthetic construct

SEQ ID NO: 4979 - protein, 214 aa, Artificial Sequence; identical to SEQ ID NO: 438
  synthetic construct

SEQ ID NO: 4980 - protein, 217 aa, Artificial Sequence; identical to SEQ ID NO: 439
  synthetic construct

SEQ ID NO: 4981 - protein, 214 aa, Artificial Sequence; identical to SEQ ID NO: 440
  synthetic construct

SEQ ID NO: 4982 - protein, 217 aa, Artificial Sequence; identical to SEQ ID NO: 441
  synthetic construct

SEQ ID NO: 4983 - protein, 220 aa, Artificial Sequence; identical to SEQ ID NO: 442
  synthetic construct

SEQ ID NO: 4984 - protein, 216 aa, Artificial Sequence; identical to SEQ ID NO: 443
  synthetic construct

SEQ ID NO: 4985 - protein, 213 aa, Artificial Sequence; identical to SEQ ID NO: 444
  synthetic construct

SEQ ID NO: 4986 - protein, 215 aa, Artificial Sequence; identical to SEQ ID NO: 445
  synthetic construct

SEQ ID NO: 4987 - protein, 215 aa, Artificial Sequence; identical to SEQ ID NO: 446
  synthetic construct

SEQ ID NO: 4988 - protein, 217 aa, Artificial Sequence; identical to SEQ ID NO: 447
  synthetic construct

SEQ ID NO: 4989 - protein, 214 aa, Artificial Sequence; identical to SEQ ID NO: 448
  synthetic construct

SEQ ID NO: 4990 - protein, 215 aa, Artificial Sequence; identical to SEQ ID NO: 449
  synthetic construct

SEQ ID NO: 4991 - protein, 216 aa, Artificial Sequence; identical to SEQ ID NO: 450
  synthetic construct

SEQ ID NO: 4992 - protein, 218 aa, Artificial Sequence; identical to SEQ ID NO: 451
  synthetic construct

SEQ ID NO: 4993 - protein, 216 aa, Artificial Sequence; identical to SEQ ID NO: 452
  synthetic construct

SEQ ID NO: 4994 - protein, 214 aa, Artificial Sequence; identical to SEQ ID NO: 453
  synthetic construct

SEQ ID NO: 4995 - protein, 213 aa, Artificial Sequence; identical to SEQ ID NO: 454
  synthetic construct

SEQ ID NO: 4996 - protein, 213 aa, Artificial Sequence; identical to SEQ ID NO: 455
  synthetic construct

SEQ ID NO: 4997 - protein, 214 aa, Artificial Sequence; identical to SEQ ID NO: 456
  synthetic construct

SEQ ID NO: 4998 - protein, 214 aa, Artificial Sequence; identical to SEQ ID NO: 457
  synthetic construct

SEQ ID NO: 4999 - protein, 219 aa, Artificial Sequence; identical to SEQ ID NO: 458
  synthetic construct

SEQ ID NO: 5000 - protein, 212 aa, Artificial Sequence; identical to SEQ ID NO: 459
  synthetic construct

SEQ ID NO: 5001 - protein, 214 aa, Artificial Sequence; identical to SEQ ID NO: 460
  synthetic construct

SEQ ID NO: 5002 - protein, 215 aa, Artificial Sequence; identical to SEQ ID NO: 461
  synthetic construct

SEQ ID NO: 5003 - protein, 220 aa, Artificial Sequence; identical to SEQ ID NO: 462
  synthetic construct

SEQ ID NO: 5004 - protein, 220 aa, Artificial Sequence; identical to SEQ ID NO: 463
  synthetic construct

SEQ ID NO: 5005 - protein, 216 aa, Artificial Sequence; identical to SEQ ID NO: 464
  synthetic construct

SEQ ID NO: 5006 - protein, 220 aa, Artificial Sequence; identical to SEQ ID NO: 465
  synthetic construct

SEQ ID NO: 5007 - protein, 111 aa, Artificial Sequence; identical to SEQ ID NO: 466
  synthetic construct

SEQ ID NO: 5008 - protein, 214 aa, Artificial Sequence; identical to SEQ ID NO: 467
  synthetic construct

SEQ ID NO: 5009 - protein, 103 aa, Artificial Sequence; identical to SEQ ID NO: 468
  synthetic construct

SEQ ID NO: 5010 - protein, 109 aa, Artificial Sequence; identical to SEQ ID NO: 469
  synthetic construct

SEQ ID NO: 5011 - protein, 215 aa, Artificial Sequence; identical to SEQ ID NO: 470
  synthetic construct

SEQ ID NO: 5012 - protein, 111 aa, Artificial Sequence; identical to SEQ ID NO: 471
  synthetic construct

SEQ ID NO: 5013 - protein, 113 aa, Artificial Sequence; identical to SEQ ID NO: 472
  synthetic construct

SEQ ID NO: 5014 - protein, 214 aa, Artificial Sequence; identical to SEQ ID NO: 473
  synthetic construct

SEQ ID NO: 5015 - protein, 214 aa, Artificial Sequence; identical to SEQ ID NO: 474
  synthetic construct

SEQ ID NO: 5016 - protein, 217 aa, Artificial Sequence; identical to SEQ ID NO: 475
  synthetic construct

SEQ ID NO: 5017 - protein, 217 aa, Artificial Sequence; identical to SEQ ID NO: 476
  synthetic construct

SEQ ID NO: 5018 - protein, 217 aa, Artificial Sequence; identical to SEQ ID NO: 477
  synthetic construct

SEQ ID NO: 5019 - protein, 214 aa, Artificial Sequence; identical to SEQ ID NO: 478
  synthetic construct

SEQ ID NO: 5020 - protein, 214 aa, Artificial Sequence; identical to SEQ ID NO: 479
  synthetic construct

SEQ ID NO: 5021 - protein, 216 aa, Artificial Sequence; identical to SEQ ID NO: 480
  synthetic construct

SEQ ID NO: 5022 - protein, 216 aa, Artificial Sequence; identical to SEQ ID NO: 481
  synthetic construct

SEQ ID NO: 5023 - protein, 216 aa, Artificial Sequence; identical to SEQ ID NO: 482
  synthetic construct

SEQ ID NO: 5024 - protein, 215 aa, Artificial Sequence; identical to SEQ ID NO: 483
  synthetic construct

SEQ ID NO: 5025 - protein, 216 aa, Artificial Sequence; identical to SEQ ID NO: 484
  synthetic construct

SEQ ID NO: 5026 - protein, 218 aa, Artificial Sequence; identical to SEQ ID NO: 485
  synthetic construct

SEQ ID NO: 5027 - protein, 217 aa, Artificial Sequence; identical to SEQ ID NO: 486
  synthetic construct

SEQ ID NO: 5028 - protein, 215 aa, Artificial Sequence; identical to SEQ ID NO: 487
  synthetic construct

SEQ ID NO: 5029 - protein, 216 aa, Artificial Sequence; identical to SEQ ID NO: 488
  synthetic construct

SEQ ID NO: 5030 - protein, 110 aa, Artificial Sequence; identical to SEQ ID NO: 489
  synthetic construct

SEQ ID NO: 5031 - protein, 113 aa, Artificial Sequence; identical to SEQ ID NO: 490
  synthetic construct

SEQ ID NO: 5032 - protein, 216 aa, Artificial Sequence; identical to SEQ ID NO: 491
  synthetic construct

SEQ ID NO: 5033 - protein, 215 aa, Artificial Sequence; identical to SEQ ID NO: 492
  synthetic construct

SEQ ID NO: 5034 - protein, 111 aa, Artificial Sequence; identical to SEQ ID NO: 493
  synthetic construct

SEQ ID NO: 5035 - protein, 107 aa, Artificial Sequence; identical to SEQ ID NO: 494
  synthetic construct

SEQ ID NO: 5036 - protein, 214 aa, Artificial Sequence; identical to SEQ ID NO: 495
  synthetic construct

SEQ ID NO: 5037 - protein, 108 aa, Artificial Sequence; identical to SEQ ID NO: 496
  synthetic construct

SEQ ID NO: 5038 - protein, 113 aa, Artificial Sequence; identical to SEQ ID NO: 497
  synthetic construct

SEQ ID NO: 5039 - protein, 220 aa, Artificial Sequence; identical to SEQ ID NO: 498
  synthetic construct

SEQ ID NO: 5040 - protein, 107 aa, Artificial Sequence; identical to SEQ ID NO: 499
  synthetic construct

SEQ ID NO: 5041 - protein, 214 aa, Artificial Sequence; identical to SEQ ID NO: 500
  synthetic construct

SEQ ID NO: 5042 - protein, 214 aa, Artificial Sequence; identical to SEQ ID NO: 501
  synthetic construct

SEQ ID NO: 5043 - protein, 215 aa, Artificial Sequence; identical to SEQ ID NO: 502
  synthetic construct

SEQ ID NO: 5044 - protein, 220 aa, Artificial Sequence; identical to SEQ ID NO: 503
  synthetic construct

SEQ ID NO: 5045 - protein, 214 aa, Artificial Sequence; identical to SEQ ID NO: 504
  synthetic construct

SEQ ID NO: 5046 - protein, 106 aa, Artificial Sequence; identical to SEQ ID NO: 505
  synthetic construct

SEQ ID NO: 5047 - protein, 220 aa, Artificial Sequence; identical to SEQ ID NO: 506
  synthetic construct

SEQ ID NO: 5048 - protein, 212 aa, Artificial Sequence; identical to SEQ ID NO: 507
  synthetic construct

SEQ ID NO: 5049 - protein, 216 aa, Artificial Sequence; identical to SEQ ID NO: 508
  synthetic construct

SEQ ID NO: 5050 - protein, 218 aa, Artificial Sequence; identical to SEQ ID NO: 509
  synthetic construct

SEQ ID NO: 5051 - protein, 214 aa, Artificial Sequence; identical to SEQ ID NO: 510
  synthetic construct

SEQ ID NO: 5052 - protein, 220 aa, Artificial Sequence; identical to SEQ ID NO: 511
  synthetic construct

SEQ ID NO: 5053 - protein, 220 aa, Artificial Sequence; identical to SEQ ID NO: 512
  synthetic construct

SEQ ID NO: 5054 - protein, 110 aa, Artificial Sequence; identical to SEQ ID NO: 513
  synthetic construct

SEQ ID NO: 5055 - protein, 219 aa, Artificial Sequence; identical to SEQ ID NO: 514
  synthetic construct

SEQ ID NO: 5056 - protein, 212 aa, Artificial Sequence; identical to SEQ ID NO: 515
  synthetic construct

SEQ ID NO: 5057 - protein, 216 aa, Artificial Sequence; identical to SEQ ID NO: 516
  synthetic construct

SEQ ID NO: 5058 - protein, 106 aa, Artificial Sequence; identical to SEQ ID NO: 517
  synthetic construct

SEQ ID NO: 5059 - protein, 219 aa, Artificial Sequence; identical to SEQ ID NO: 518
  synthetic construct

SEQ ID NO: 5060 - protein, 216 aa, Artificial Sequence; identical to SEQ ID NO: 519
  synthetic construct

SEQ ID NO: 5061 - protein, 213 aa, Artificial Sequence; identical to SEQ ID NO: 520
  synthetic construct

SEQ ID NO: 5062 - protein, 214 aa, Artificial Sequence; identical to SEQ ID NO: 521
  synthetic construct

SEQ ID NO: 5063 - protein, 218 aa, Artificial Sequence; identical to SEQ ID NO: 522
  synthetic construct

SEQ ID NO: 5064 - protein, 213 aa, Artificial Sequence; identical to SEQ ID NO: 523
  synthetic construct

SEQ ID NO: 5065 - protein, 102 aa, Artificial Sequence; identical to SEQ ID NO: 524
  synthetic construct

SEQ ID NO: 5066 - protein, 106 aa, Artificial Sequence; identical to SEQ ID NO: 525
  synthetic construct

SEQ ID NO: 5067 - protein, 214 aa, Artificial Sequence; identical to SEQ ID NO: 526
  synthetic construct

SEQ ID NO: 5068 - protein, 214 aa, Artificial Sequence; identical to SEQ ID NO: 527
  synthetic construct

SEQ ID NO: 5069 - protein, 216 aa, Artificial Sequence; identical to SEQ ID NO: 528
  synthetic construct

SEQ ID NO: 5070 - protein, 108 aa, Artificial Sequence; identical to SEQ ID NO: 529
  synthetic construct

SEQ ID NO: 5071 - protein, 217 aa, Artificial Sequence; identical to SEQ ID NO: 530
  synthetic construct

SEQ ID NO: 5072 - protein, 219 aa, Artificial Sequence; identical to SEQ ID NO: 531
  synthetic construct

SEQ ID NO: 5073 - protein, 213 aa, Artificial Sequence; identical to SEQ ID NO: 532
  synthetic construct

SEQ ID NO: 5074 - protein, 219 aa, Artificial Sequence; identical to SEQ ID NO: 533
  synthetic construct

SEQ ID NO: 5075 - protein, 215 aa, Artificial Sequence; identical to SEQ ID NO: 534
  synthetic construct

SEQ ID NO: 5076 - protein, 220 aa, Artificial Sequence; identical to SEQ ID NO: 535
  synthetic construct

SEQ ID NO: 5077 - protein, 217 aa, Artificial Sequence; identical to SEQ ID NO: 536
  synthetic construct

SEQ ID NO: 5078 - protein, 217 aa, Artificial Sequence; identical to SEQ ID NO: 537
  synthetic construct

SEQ ID NO: 5079 - protein, 218 aa, Artificial Sequence; identical to SEQ ID NO: 538
  synthetic construct

SEQ ID NO: 5080 - protein, 220 aa, Artificial Sequence; identical to SEQ ID NO: 539
  synthetic construct

SEQ ID NO: 5081 - protein, 219 aa, Artificial Sequence; identical to SEQ ID NO: 540
  synthetic construct

SEQ ID NO: 5082 - protein, 214 aa, Artificial Sequence; identical to SEQ ID NO: 541
  synthetic construct

SEQ ID NO: 5083 - protein, 219 aa, Artificial Sequence; identical to SEQ ID NO: 542
  synthetic construct

SEQ ID NO: 5084 - protein, 8 aa, Artificial Sequence
  synthetic construct
EVTFNTYG

SEQ ID NO: 5085 - protein, 8 aa, Artificial Sequence
  synthetic construct
GFTFSSYW

SEQ ID NO: 5086 - protein, 8 aa, Artificial Sequence
  synthetic construct
GFTFEDYA

SEQ ID NO: 5087 - protein, 10 aa, Artificial Sequence
  synthetic construct
GFSLSTSGVG

SEQ ID NO: 5088 - protein, 8 aa, Artificial Sequence
  synthetic construct
GYTFTTYY

SEQ ID NO: 5089 - protein, 8 aa, Artificial Sequence
  synthetic construct
GFVFDDYA

SEQ ID NO: 5090 - protein, 8 aa, Artificial Sequence
  synthetic construct
GYTFTNYG

SEQ ID NO: 5091 - protein, 8 aa, Artificial Sequence
  synthetic construct
GFTFDDYA

SEQ ID NO: 5092 - protein, 8 aa, Artificial Sequence
  synthetic construct
GFTFSYYG

SEQ ID NO: 5093 - protein, 8 aa, Artificial Sequence
  synthetic construct
GFPFGDYA

SEQ ID NO: 5094 - protein, 8 aa, Artificial Sequence
  synthetic construct
GYIDINNG

SEQ ID NO: 5095 - protein, 8 aa, Artificial Sequence
  synthetic construct
GFTFTRHG

SEQ ID NO: 5096 - protein, 8 aa, Artificial Sequence
  synthetic construct
RFTFSSYA

SEQ ID NO: 5097 - protein, 10 aa, Artificial Sequence
  synthetic construct
GDGVSSNSAS

SEQ ID NO: 5098 - protein, 8 aa, Artificial Sequence
  synthetic construct
GFAFSSNG

SEQ ID NO: 5099 - protein, 8 aa, Artificial Sequence
  synthetic construct
GITFSSYD

SEQ ID NO: 5100 - protein, 8 aa, Artificial Sequence
  synthetic construct
GYNFTNYG

SEQ ID NO: 5101 - protein, 8 aa, Artificial Sequence
  synthetic construct
GFSFRSYE

SEQ ID NO: 5102 - protein, 8 aa, Artificial Sequence
  synthetic construct
GYIFTSYA

SEQ ID NO: 5103 - protein, 9 aa, Artificial Sequence
  synthetic construct
GYLISSGYY

SEQ ID NO: 5104 - protein, 10 aa, Artificial Sequence
  synthetic construct
GFSLNTSGVG

SEQ ID NO: 5105 - protein, 8 aa, Artificial Sequence
  synthetic construct
GFTFSNYS

SEQ ID NO: 5106 - protein, 8 aa, Artificial Sequence
  synthetic construct
GFTFSSYS

SEQ ID NO: 5107 - protein, 8 aa, Artificial Sequence
  synthetic construct
GDSMSFYY

SEQ ID NO: 5108 - protein, 10 aa, Artificial Sequence
  synthetic construct
GGSISSGSYY

SEQ ID NO: 5109 - protein, 8 aa, Artificial Sequence
  synthetic construct
GFSFSSYS

SEQ ID NO: 5110 - protein, 10 aa, Artificial Sequence
  synthetic construct
GGSISRSPYF

SEQ ID NO: 5111 - protein, 8 aa, Artificial Sequence
  synthetic construct
GFTFTSYG

SEQ ID NO: 5112 - protein, 8 aa, Artificial Sequence
  synthetic construct
SGSSGSYY

SEQ ID NO: 5113 - protein, 8 aa, Artificial Sequence
  synthetic construct
GYNFRDYY

SEQ ID NO: 5114 - protein, 10 aa, Artificial Sequence
  synthetic construct
GGSINSGDYH

SEQ ID NO: 5115 - protein, 10 aa, Artificial Sequence
  synthetic construct
GGSISSSGYY

SEQ ID NO: 5116 - protein, 8 aa, Artificial Sequence
  synthetic construct
GFTFSSYG

SEQ ID NO: 5117 - protein, 10 aa, Artificial Sequence
  synthetic construct
GFSLTTSGVG

SEQ ID NO: 5118 - protein, 8 aa, Artificial Sequence
  synthetic construct
GFTFSTYE

SEQ ID NO: 5119 - protein, 8 aa, Artificial Sequence
  synthetic construct
GGTFSSYA

SEQ ID NO: 5120 - protein, 10 aa, Artificial Sequence
  synthetic construct
GGSISSDNYY

SEQ ID NO: 5121 - protein, 8 aa, Artificial Sequence
  synthetic construct
GASISSYY

SEQ ID NO: 5122 - protein, 8 aa, Artificial Sequence
  synthetic construct
GNTFTTYT

SEQ ID NO: 5123 - protein, 8 aa, Artificial Sequence
  synthetic construct
GFTFSSYA

SEQ ID NO: 5124 - protein, 8 aa, Artificial Sequence
  synthetic construct
GFTFDDYG

SEQ ID NO: 5125 - protein, 8 aa, Artificial Sequence
  synthetic construct
GFTFSSYG

SEQ ID NO: 5126 - protein, 10 aa, Artificial Sequence
  synthetic construct
GGSISSGGYY

SEQ ID NO: 5127 - protein, 8 aa, Artificial Sequence
  synthetic construct
GYTFTGYY

SEQ ID NO: 5128 - protein, 8 aa, Artificial Sequence
  synthetic construct
GFTFSSYD

SEQ ID NO: 5129 - protein, 8 aa, Artificial Sequence
  synthetic construct
GFTFRSYG

SEQ ID NO: 5130 - protein, 8 aa, Artificial Sequence
  synthetic construct
GFTFSDYY

SEQ ID NO: 5131 - protein, 8 aa, Artificial Sequence
  synthetic construct
GFTFSSYH

SEQ ID NO: 5132 - protein, 8 aa, Artificial Sequence
  synthetic construct
GFTFSSYA

SEQ ID NO: 5133 - protein, 8 aa, Artificial Sequence
  synthetic construct
GFTLEEFA

SEQ ID NO: 5134 - protein, 8 aa, Artificial Sequence
  synthetic construct
GGSISDYY

SEQ ID NO: 5135 - protein, 8 aa, Artificial Sequence
  synthetic construct
GGTFSSYA

SEQ ID NO: 5136 - protein, 8 aa, Artificial Sequence
  synthetic construct
GYTFSSYG

SEQ ID NO: 5137 - protein, 8 aa, Artificial Sequence
  synthetic construct
GFTFRSYE

SEQ ID NO: 5138 - protein, 8 aa, Artificial Sequence
  synthetic construct
GGTFSSYA

SEQ ID NO: 5139 - protein, 8 aa, Artificial Sequence
  synthetic construct
GDSFNKYF

SEQ ID NO: 5140 - protein, 8 aa, Artificial Sequence
  synthetic construct
GFTFSTYG

SEQ ID NO: 5141 - protein, 8 aa, Artificial Sequence
  synthetic construct
GFAFSSYA

SEQ ID NO: 5142 - protein, 8 aa, Artificial Sequence
  synthetic construct
GFTFSNHA

SEQ ID NO: 5143 - protein, 8 aa, Artificial Sequence
  synthetic construct
GFTFSSHG

SEQ ID NO: 5144 - protein, 10 aa, Artificial Sequence
  synthetic construct
GGSVDNVDSY

SEQ ID NO: 5145 - protein, 8 aa, Artificial Sequence
  synthetic construct
GYSFTTYW

SEQ ID NO: 5146 - protein, 10 aa, Artificial Sequence
  synthetic construct
GDSISSGSYY

SEQ ID NO: 5147 - protein, 10 aa, Artificial Sequence
  synthetic construct
GDSVSSNSAA

SEQ ID NO: 5148 - protein, 8 aa, Artificial Sequence
  synthetic construct
GYTLSELS

SEQ ID NO: 5149 - protein, 8 aa, Artificial Sequence
  synthetic construct
GFTFSSYS

SEQ ID NO: 5150 - protein, 8 aa, Artificial Sequence
  synthetic construct
GFTFSNYA

SEQ ID NO: 5151 - protein, 8 aa, Artificial Sequence
  synthetic construct
GGPFSSYT

SEQ ID NO: 5152 - protein, 10 aa, Artificial Sequence
  synthetic construct
GGSVNTGTSY

SEQ ID NO: 5153 - protein, 8 aa, Artificial Sequence
  synthetic construct
GFHFGSHG

SEQ ID NO: 5154 - protein, 10 aa, Artificial Sequence
  synthetic construct
GGSITTGSYY

SEQ ID NO: 5155 - protein, 8 aa, Artificial Sequence
  synthetic construct
GFTFDDYA

SEQ ID NO: 5156 - protein, 8 aa, Artificial Sequence
  synthetic construct
GASMNNYY

SEQ ID NO: 5157 - protein, 10 aa, Artificial Sequence
  synthetic construct
GFSLTTTDVG

SEQ ID NO: 5158 - protein, 8 aa, Artificial Sequence
  synthetic construct
GFTFSSYS

SEQ ID NO: 5159 - protein, 8 aa, Artificial Sequence
  synthetic construct
GYNFISHW

SEQ ID NO: 5160 - protein, 8 aa, Artificial Sequence
  synthetic construct
GYSFTSFW

SEQ ID NO: 5161 - protein, 8 aa, Artificial Sequence
  synthetic construct
GGSIDSYY

SEQ ID NO: 5162 - protein, 8 aa, Artificial Sequence
  synthetic construct
GGIFSYFA

SEQ ID NO: 5163 - protein, 8 aa, Artificial Sequence
  synthetic construct
EFSFQYFS

SEQ ID NO: 5164 - protein, 9 aa, Artificial Sequence
  synthetic construct
GYTLNNDVA

SEQ ID NO: 5165 - protein, 8 aa, Artificial Sequence
  synthetic construct
GFRFNYYW

SEQ ID NO: 5166 - protein, 10 aa, Artificial Sequence
  synthetic construct
GGSISGDKNF

SEQ ID NO: 5167 - protein, 8 aa, Artificial Sequence
  synthetic construct
GFTFSDYE

SEQ ID NO: 5168 - protein, 8 aa, Artificial Sequence
  synthetic construct
GFPPRSFA

SEQ ID NO: 5169 - protein, 8 aa, Artificial Sequence
  synthetic construct
GFTFSNYG

SEQ ID NO: 5170 - protein, 8 aa, Artificial Sequence
  synthetic construct
GFTFDDYT

SEQ ID NO: 5171 - protein, 8 aa, Artificial Sequence
  synthetic construct
GDTFPNYV

SEQ ID NO: 5172 - protein, 8 aa, Artificial Sequence
  synthetic construct
GFTFDDYA

SEQ ID NO: 5173 - protein, 8 aa, Artificial Sequence
  synthetic construct
GFTFSSYA

SEQ ID NO: 5174 - protein, 8 aa, Artificial Sequence
  synthetic construct
GFTFSNYD

SEQ ID NO: 5175 - protein, 8 aa, Artificial Sequence
  synthetic construct
GFTFSPYS

SEQ ID NO: 5176 - protein, 10 aa, Artificial Sequence
  synthetic construct
GGSITSGSYF

SEQ ID NO: 5177 - protein, 10 aa, Artificial Sequence
  synthetic construct
GGSVSSSSYY

SEQ ID NO: 5178 - protein, 8 aa, Artificial Sequence
  synthetic construct
GFTFSNYD

SEQ ID NO: 5179 - protein, 8 aa, Artificial Sequence
  synthetic construct
GYAFIGNW

SEQ ID NO: 5180 - protein, 10 aa, Artificial Sequence
  synthetic construct
GFTFSFSSYA

SEQ ID NO: 5181 - protein, 8 aa, Artificial Sequence
  synthetic construct
GFTFNNYE

SEQ ID NO: 5182 - protein, 8 aa, Artificial Sequence
  synthetic construct
GFTFSSNW

SEQ ID NO: 5183 - protein, 10 aa, Artificial Sequence
  synthetic construct
GGSISSGGYY

SEQ ID NO: 5184 - protein, 8 aa, Artificial Sequence
  synthetic construct
GFTFSSYG

SEQ ID NO: 5185 - protein, 8 aa, Artificial Sequence
  synthetic construct
GFTFSDYY

SEQ ID NO: 5186 - protein, 10 aa, Artificial Sequence
  synthetic construct
GGSISSGGYP

SEQ ID NO: 5187 - protein, 8 aa, Artificial Sequence
  synthetic construct
GGSISIYY

SEQ ID NO: 5188 - protein, 8 aa, Artificial Sequence
  synthetic construct
NSSISSYY

SEQ ID NO: 5189 - protein, 8 aa, Artificial Sequence
  synthetic construct
GFTFNSYW

SEQ ID NO: 5190 - protein, 8 aa, Artificial Sequence
  synthetic construct
GFTFDDYA

SEQ ID NO: 5191 - protein, 8 aa, Artificial Sequence
  synthetic construct
GYRFNAYW

SEQ ID NO: 5192 - protein, 10 aa, Artificial Sequence
  synthetic construct
GDSVSSTSGA

SEQ ID NO: 5193 - protein, 10 aa, Artificial Sequence
  synthetic construct
GDSVSSNSAA

SEQ ID NO: 5194 - protein, 8 aa, Artificial Sequence
  synthetic construct
GGSISSYY

SEQ ID NO: 5195 - protein, 8 aa, Artificial Sequence
  synthetic construct
GYSFTSYW

SEQ ID NO: 5196 - protein, 8 aa, Artificial Sequence
  synthetic construct
GFTFSSYG

SEQ ID NO: 5197 - protein, 8 aa, Artificial Sequence
  synthetic construct
GFTFRSYS

SEQ ID NO: 5198 - protein, 8 aa, Artificial Sequence
  synthetic construct
GGTFSSYT

SEQ ID NO: 5199 - protein, 8 aa, Artificial Sequence
  synthetic construct
GFSFSRYN

SEQ ID NO: 5200 - protein, 8 aa, Artificial Sequence
  synthetic construct
GFTFTNYA

SEQ ID NO: 5201 - protein, 8 aa, Artificial Sequence
  synthetic construct
GFSFSSFG

SEQ ID NO: 5202 - protein, 8 aa, Artificial Sequence
  synthetic construct
GFTFSSYA

SEQ ID NO: 5203 - protein, 8 aa, Artificial Sequence
  synthetic construct
GFTFSSHG

SEQ ID NO: 5204 - protein, 8 aa, Artificial Sequence
  synthetic construct
GFSFSTYW

SEQ ID NO: 5205 - protein, 8 aa, Artificial Sequence
  synthetic construct
GFTFNNYW

SEQ ID NO: 5206 - protein, 8 aa, Artificial Sequence
  synthetic construct
GFTFSHGW

SEQ ID NO: 5207 - protein, 8 aa, Artificial Sequence
  synthetic construct
GGSIRNDY

SEQ ID NO: 5208 - protein, 8 aa, Artificial Sequence
  synthetic construct
GGTFSSYA

SEQ ID NO: 5209 - protein, 10 aa, Artificial Sequence
  synthetic construct
GGSISSSNYF

SEQ ID NO: 5210 - protein, 8 aa, Artificial Sequence
  synthetic construct
GFTFSDYW

SEQ ID NO: 5211 - protein, 10 aa, Artificial Sequence
  synthetic construct
DVSIISSFYY

SEQ ID NO: 5212 - protein, 10 aa, Artificial Sequence
  synthetic construct
GASVSSGSYY

SEQ ID NO: 5213 - protein, 8 aa, Artificial Sequence
  synthetic construct
GGTFSGYG

SEQ ID NO: 5214 - protein, 8 aa, Artificial Sequence
  synthetic construct
GFTFSSYW

SEQ ID NO: 5215 - protein, 10 aa, Artificial Sequence
  synthetic construct
GGSISSGDYY

SEQ ID NO: 5216 - protein, 8 aa, Artificial Sequence
  synthetic construct
GFTFSSYA

SEQ ID NO: 5217 - protein, 8 aa, Artificial Sequence
  synthetic construct
GFTFSSYA

SEQ ID NO: 5218 - protein, 8 aa, Artificial Sequence
  synthetic construct
GFTLSSYA

SEQ ID NO: 5219 - protein, 10 aa, Artificial Sequence
  synthetic construct
GGSISSGGYS

SEQ ID NO: 5220 - protein, 8 aa, Artificial Sequence
  synthetic construct
GFTFSNSA

SEQ ID NO: 5221 - protein, 8 aa, Artificial Sequence
  synthetic construct
GYTFTSHY

SEQ ID NO: 5222 - protein, 8 aa, Artificial Sequence
  synthetic construct
GFTFSAYW

SEQ ID NO: 5223 - protein, 8 aa, Artificial Sequence
  synthetic construct
GYSLTEIS

SEQ ID NO: 5224 - protein, 10 aa, Artificial Sequence
  synthetic construct
GGSIRSSAPF

SEQ ID NO: 5225 - protein, 8 aa, Artificial Sequence
  synthetic construct
GYIFTTYV

SEQ ID NO: 5226 - protein, 8 aa, Artificial Sequence
  synthetic construct
GFTFDDYA

SEQ ID NO: 5227 - protein, 8 aa, Artificial Sequence
  synthetic construct
GFTFNNYW

SEQ ID NO: 5228 - protein, 8 aa, Artificial Sequence
  synthetic construct
GDSVSSFY

SEQ ID NO: 5229 - protein, 8 aa, Artificial Sequence
  synthetic construct
GYNFNDDR

SEQ ID NO: 5230 - protein, 8 aa, Artificial Sequence
  synthetic construct
GFTVSTNY

SEQ ID NO: 5231 - protein, 8 aa, Artificial Sequence
  synthetic construct
GFTFSDHY

SEQ ID NO: 5232 - protein, 8 aa, Artificial Sequence
  synthetic construct
GFTFRDYG

SEQ ID NO: 5233 - protein, 8 aa, Artificial Sequence
  synthetic construct
GFDIRSYT

SEQ ID NO: 5234 - protein, 8 aa, Artificial Sequence
  synthetic construct
GYTFTDYY

SEQ ID NO: 5235 - protein, 8 aa, Artificial Sequence
  synthetic construct
GFTFSNYA

SEQ ID NO: 5236 - protein, 8 aa, Artificial Sequence
  synthetic construct
GFNFNSYT

SEQ ID NO: 5237 - protein, 8 aa, Artificial Sequence
  synthetic construct
GFTFDDYA

SEQ ID NO: 5238 - protein, 8 aa, Artificial Sequence
  synthetic construct
GGTFSSYG

SEQ ID NO: 5239 - protein, 8 aa, Artificial Sequence
  synthetic construct
GLTFNRFA

SEQ ID NO: 5240 - protein, 9 aa, Artificial Sequence
  synthetic construct
GYSISTAYY

SEQ ID NO: 5241 - protein, 8 aa, Artificial Sequence
  synthetic construct
GGNVRSYS

SEQ ID NO: 5242 - protein, 8 aa, Artificial Sequence
  synthetic construct
GDSISSNY

SEQ ID NO: 5243 - protein, 8 aa, Artificial Sequence
  synthetic construct
GYRFSNFG

SEQ ID NO: 5244 - protein, 8 aa, Artificial Sequence
  synthetic construct
GYTFTNYA

SEQ ID NO: 5245 - protein, 10 aa, Artificial Sequence
  synthetic construct
GDSISSSSYF

SEQ ID NO: 5246 - protein, 8 aa, Artificial Sequence
  synthetic construct
GFTFSNYG

SEQ ID NO: 5247 - protein, 8 aa, Artificial Sequence
  synthetic construct
GGSFNTYA

SEQ ID NO: 5248 - protein, 8 aa, Artificial Sequence
  synthetic construct
GDTFTSFA

SEQ ID NO: 5249 - protein, 10 aa, Artificial Sequence
  synthetic construct
GDSISNGDYC

SEQ ID NO: 5250 - protein, 8 aa, Artificial Sequence
  synthetic construct
GFTFRSYW

SEQ ID NO: 5251 - protein, 8 aa, Artificial Sequence
  synthetic construct
GFTYDSYV

SEQ ID NO: 5252 - protein, 10 aa, Artificial Sequence
  synthetic construct
SGSVSSGSHY

SEQ ID NO: 5253 - protein, 8 aa, Artificial Sequence
  synthetic construct
GYSFTGYY

SEQ ID NO: 5254 - protein, 8 aa, Artificial Sequence
  synthetic construct
GFTFSNYG

SEQ ID NO: 5255 - protein, 8 aa, Artificial Sequence
  synthetic construct
GFTFSNYN

SEQ ID NO: 5256 - protein, 10 aa, Artificial Sequence
  synthetic construct
GGSISSSSYY

SEQ ID NO: 5257 - protein, 8 aa, Artificial Sequence
  synthetic construct
GFTFSNAW

SEQ ID NO: 5258 - protein, 8 aa, Artificial Sequence
  synthetic construct
GYTFTNYF

SEQ ID NO: 5259 - protein, 8 aa, Artificial Sequence
  synthetic construct
GGTFNNYG

SEQ ID NO: 5260 - protein, 8 aa, Artificial Sequence
  synthetic construct
GFTFSSYE

SEQ ID NO: 5261 - protein, 8 aa, Artificial Sequence
  synthetic construct
GFTFTTYA

SEQ ID NO: 5262 - protein, 8 aa, Artificial Sequence
  synthetic construct
GYTFTSYW

SEQ ID NO: 5263 - protein, 8 aa, Artificial Sequence
  synthetic construct
GLTFSIYS

SEQ ID NO: 5264 - protein, 10 aa, Artificial Sequence
  synthetic construct
GFSLSNARMG

SEQ ID NO: 5265 - protein, 8 aa, Artificial Sequence
  synthetic construct
GYTFTVYY

SEQ ID NO: 5266 - protein, 8 aa, Artificial Sequence
  synthetic construct
GYTFTSYG

SEQ ID NO: 5267 - protein, 10 aa, Artificial Sequence
  synthetic construct
GDSVSSTSAA

SEQ ID NO: 5268 - protein, 9 aa, Artificial Sequence
  synthetic construct
GGSISSSNC

SEQ ID NO: 5269 - protein, 8 aa, Artificial Sequence
  synthetic construct
GFTVSSNY

SEQ ID NO: 5270 - protein, 8 aa, Artificial Sequence
  synthetic construct
GYTFTTYY

SEQ ID NO: 5271 - protein, 10 aa, Artificial Sequence
  synthetic construct
GGSVSSGSYY

SEQ ID NO: 5272 - protein, 10 aa, Artificial Sequence
  synthetic construct
GGSISSSFFY

SEQ ID NO: 5273 - protein, 8 aa, Artificial Sequence
  synthetic construct
GFTFSSYA

SEQ ID NO: 5274 - protein, 8 aa, Artificial Sequence
  synthetic construct
GFTFSTYV

SEQ ID NO: 5275 - protein, 10 aa, Artificial Sequence
  synthetic construct
GGSISSSSYY

SEQ ID NO: 5276 - protein, 8 aa, Artificial Sequence
  synthetic construct
GYTFTGYY

SEQ ID NO: 5277 - protein, 8 aa, Artificial Sequence
  synthetic construct
GYSFTSYW

SEQ ID NO: 5278 - protein, 8 aa, Artificial Sequence
  synthetic construct
GYSFTTYW

SEQ ID NO: 5279 - protein, 8 aa, Artificial Sequence
  synthetic construct
GFTFRIYA

SEQ ID NO: 5280 - protein, 8 aa, Artificial Sequence
  synthetic construct
GYTFTSYY

SEQ ID NO: 5281 - protein, 8 aa, Artificial Sequence
  synthetic construct
GLDFRDYY

SEQ ID NO: 5282 - protein, 8 aa, Artificial Sequence
  synthetic construct
GFTFISYA

SEQ ID NO: 5283 - protein, 8 aa, Artificial Sequence
  synthetic construct
GYTFTSHA

SEQ ID NO: 5284 - protein, 8 aa, Artificial Sequence
  synthetic construct
GYTFTNYA

SEQ ID NO: 5285 - protein, 8 aa, Artificial Sequence
  synthetic construct
GFTFSNFA

SEQ ID NO: 5286 - protein, 8 aa, Artificial Sequence
  synthetic construct
GFTFSHYA

SEQ ID NO: 5287 - protein, 8 aa, Artificial Sequence
  synthetic construct
GFTFSSYS

SEQ ID NO: 5288 - protein, 10 aa, Artificial Sequence
  synthetic construct
GFSLSTNGVG

SEQ ID NO: 5289 - protein, 10 aa, Artificial Sequence
  synthetic construct
GLSLSTSGVA

SEQ ID NO: 5290 - protein, 10 aa, Artificial Sequence
  synthetic construct
GGSISSGGYC

SEQ ID NO: 5291 - protein, 8 aa, Artificial Sequence
  synthetic construct
GFTFSSYW

SEQ ID NO: 5292 - protein, 8 aa, Artificial Sequence
  synthetic construct
RGTFSNHA

SEQ ID NO: 5293 - protein, 8 aa, Artificial Sequence
  synthetic construct
GGTFNFYA

SEQ ID NO: 5294 - protein, 8 aa, Artificial Sequence
  synthetic construct
GYNFIDNA

SEQ ID NO: 5295 - protein, 8 aa, Artificial Sequence
  synthetic construct
GYTFTHYG

SEQ ID NO: 5296 - protein, 8 aa, Artificial Sequence
  synthetic construct
GFTFSNYA

SEQ ID NO: 5297 - protein, 8 aa, Artificial Sequence
  synthetic construct
GYTFSSYY

SEQ ID NO: 5298 - protein, 8 aa, Artificial Sequence
  synthetic construct
GYNFSRYW

SEQ ID NO: 5299 - protein, 8 aa, Artificial Sequence
  synthetic construct
GFTFNRYG

SEQ ID NO: 5300 - protein, 8 aa, Artificial Sequence
  synthetic construct
GYSFTSFW

SEQ ID NO: 5301 - protein, 8 aa, Artificial Sequence
  synthetic construct
GFTLDDYV

SEQ ID NO: 5302 - protein, 10 aa, Artificial Sequence
  synthetic construct
GDSISSSGFF

SEQ ID NO: 5303 - protein, 8 aa, Artificial Sequence
  synthetic construct
GGPFKTYP

SEQ ID NO: 5304 - protein, 8 aa, Artificial Sequence
  synthetic construct
GFTFGDNA

SEQ ID NO: 5305 - protein, 8 aa, Artificial Sequence
  synthetic construct
GYTFSNYG

SEQ ID NO: 5306 - protein, 8 aa, Artificial Sequence
  synthetic construct
GFDFTSYW

SEQ ID NO: 5307 - protein, 8 aa, Artificial Sequence
  synthetic construct
GFTFSSYS

SEQ ID NO: 5308 - protein, 10 aa, Artificial Sequence
  synthetic construct
GVSIGTSSYY

SEQ ID NO: 5309 - protein, 8 aa, Artificial Sequence
  synthetic construct
GDSFSDYY

SEQ ID NO: 5310 - protein, 8 aa, Artificial Sequence
  synthetic construct
GFTFSNYA

SEQ ID NO: 5311 - protein, 8 aa, Artificial Sequence
  synthetic construct
GYRFTSNG

SEQ ID NO: 5312 - protein, 8 aa, Artificial Sequence
  synthetic construct
GFTFDDYG

SEQ ID NO: 5313 - protein, 8 aa, Artificial Sequence
  synthetic construct
GFSFSAYG

SEQ ID NO: 5314 - protein, 8 aa, Artificial Sequence
  synthetic construct
EFTFSAYA

SEQ ID NO: 5315 - protein, 8 aa, Artificial Sequence
  synthetic construct
GFTFSNAW

SEQ ID NO: 5316 - protein, 8 aa, Artificial Sequence
  synthetic construct
GLTFSDYG

SEQ ID NO: 5317 - protein, 8 aa, Artificial Sequence
  synthetic construct
GYVFTSFG

SEQ ID NO: 5318 - protein, 8 aa, Artificial Sequence
  synthetic construct
GFTFEDFG

SEQ ID NO: 5319 - protein, 8 aa, Artificial Sequence
  synthetic construct
GFTLSTYG

SEQ ID NO: 5320 - protein, 8 aa, Artificial Sequence
  synthetic construct
GYTFSNYA

SEQ ID NO: 5321 - protein, 8 aa, Artificial Sequence
  synthetic construct
GYSFSTYW

SEQ ID NO: 5322 - protein, 10 aa, Artificial Sequence
  synthetic construct
GFSLTTYGVG

SEQ ID NO: 5323 - protein, 8 aa, Artificial Sequence
  synthetic construct
GFTFSAYG

SEQ ID NO: 5324 - protein, 8 aa, Artificial Sequence
  synthetic construct
GGTFSEYG

SEQ ID NO: 5325 - protein, 10 aa, Artificial Sequence
  synthetic construct
GASVNSGTHF

SEQ ID NO: 5326 - protein, 8 aa, Artificial Sequence
  synthetic construct
GFTFSSYA

SEQ ID NO: 5327 - protein, 8 aa, Artificial Sequence
  synthetic construct
GFTFSSYS

SEQ ID NO: 5328 - protein, 10 aa, Artificial Sequence
  synthetic construct
GDSISRSNYY

SEQ ID NO: 5329 - protein, 8 aa, Artificial Sequence
  synthetic construct
GFTFSKFW

SEQ ID NO: 5330 - protein, 10 aa, Artificial Sequence
  synthetic construct
GFSLTTTGVG

SEQ ID NO: 5331 - protein, 8 aa, Artificial Sequence
  synthetic construct
GFIFSSYG

SEQ ID NO: 5332 - protein, 8 aa, Artificial Sequence
  synthetic construct
GFTFSSYE

SEQ ID NO: 5333 - protein, 8 aa, Artificial Sequence
  synthetic construct
GFTFSSYS

SEQ ID NO: 5334 - protein, 10 aa, Artificial Sequence
  synthetic construct
GFSLSTSGMC

SEQ ID NO: 5335 - protein, 8 aa, Artificial Sequence
  synthetic construct
GFTFSSYW

SEQ ID NO: 5336 - protein, 8 aa, Artificial Sequence
  synthetic construct
GFTFASYG

SEQ ID NO: 5337 - protein, 8 aa, Artificial Sequence
  synthetic construct
GFTFSSYS

SEQ ID NO: 5338 - protein, 8 aa, Artificial Sequence
  synthetic construct
GYIFTGSF

SEQ ID NO: 5339 - protein, 10 aa, Artificial Sequence
  synthetic construct
GGSISSGTYY

SEQ ID NO: 5340 - protein, 8 aa, Artificial Sequence
  synthetic construct
GYSFTNYW

SEQ ID NO: 5341 - protein, 8 aa, Artificial Sequence
  synthetic construct
GFTFSNAW

SEQ ID NO: 5342 - protein, 8 aa, Artificial Sequence
  synthetic construct
GFPFSTYA

SEQ ID NO: 5343 - protein, 8 aa, Artificial Sequence
  synthetic construct
GFSFSGSS

SEQ ID NO: 5344 - protein, 8 aa, Artificial Sequence
  synthetic construct
GGSISSYY

SEQ ID NO: 5345 - protein, 8 aa, Artificial Sequence
  synthetic construct
GFTFGDYA

SEQ ID NO: 5346 - protein, 8 aa, Artificial Sequence
  synthetic construct
GFTLSNYG

SEQ ID NO: 5347 - protein, 8 aa, Artificial Sequence
  synthetic construct
GFSITTHS

SEQ ID NO: 5348 - protein, 8 aa, Artificial Sequence
  synthetic construct
GFTFSSYE

SEQ ID NO: 5349 - protein, 8 aa, Artificial Sequence
  synthetic construct
GFTFSSYS

SEQ ID NO: 5350 - protein, 8 aa, Artificial Sequence
  synthetic construct
GFSVSSKY

SEQ ID NO: 5351 - protein, 8 aa, Artificial Sequence
  synthetic construct
GYSFTNYW

SEQ ID NO: 5352 - protein, 8 aa, Artificial Sequence
  synthetic construct
GFTFSGSA

SEQ ID NO: 5353 - protein, 8 aa, Artificial Sequence
  synthetic construct
GFTFSDYG

SEQ ID NO: 5354 - protein, 8 aa, Artificial Sequence
  synthetic construct
GYTFNNYG

SEQ ID NO: 5355 - protein, 6 aa, Artificial Sequence
  synthetic construct
QGVSSY

SEQ ID NO: 5356 - protein, 6 aa, Artificial Sequence
  synthetic construct
QSIGSY

SEQ ID NO: 5357 - protein, 6 aa, Artificial Sequence
  synthetic construct
QGIDVW

SEQ ID NO: 5358 - protein, 8 aa, Artificial Sequence
  synthetic construct
SSNIGSNY

SEQ ID NO: 5359 - protein, 6 aa, Artificial Sequence
  synthetic construct
SLRNYY

SEQ ID NO: 5360 - protein, 6 aa, Artificial Sequence
  synthetic construct
NIGIKS

SEQ ID NO: 5361 - protein, 6 aa, Artificial Sequence
  synthetic construct
QSISSY

SEQ ID NO: 5362 - protein, 7 aa, Artificial Sequence
  synthetic construct
QSVSSSY

SEQ ID NO: 5363 - protein, 8 aa, Artificial Sequence
  synthetic construct
SGNIASYY

SEQ ID NO: 5364 - protein, 7 aa, Artificial Sequence
  synthetic construct
QSVSSSY

SEQ ID NO: 5365 - protein, 8 aa, Artificial Sequence
  synthetic construct
SSNIENND

SEQ ID NO: 5366 - protein, 11 aa, Artificial Sequence
  synthetic construct
QSLVHSDGNTY

SEQ ID NO: 5367 - protein, 8 aa, Artificial Sequence
  synthetic construct
SSNIGRNY

SEQ ID NO: 5368 - protein, 8 aa, Artificial Sequence
  synthetic construct
ISNIGSNP

SEQ ID NO: 5369 - protein, 6 aa, Artificial Sequence
  synthetic construct
QNVNFN

SEQ ID NO: 5370 - protein, 7 aa, Artificial Sequence
  synthetic construct
QSVSSSS

SEQ ID NO: 5371 - protein, 6 aa, Artificial Sequence
  synthetic construct
ALPKQY

SEQ ID NO: 5372 - protein, 6 aa, Artificial Sequence
  synthetic construct
QSVSSY

SEQ ID NO: 5373 - protein, 6 aa, Artificial Sequence
  synthetic construct
QSVGSY

SEQ ID NO: 5374 - protein, 6 aa, Artificial Sequence
  synthetic construct
QAIANS

SEQ ID NO: 5375 - protein, 12 aa, Artificial Sequence
  synthetic construct
QSVLYSSNNENY

SEQ ID NO: 5376 - protein, 6 aa, Artificial Sequence
  synthetic construct
HNINTY

SEQ ID NO: 5377 - protein, 9 aa, Artificial Sequence
  synthetic construct
SSDVGGYNY

SEQ ID NO: 5378 - protein, 8 aa, Artificial Sequence
  synthetic construct
SANIGKNY

SEQ ID NO: 5379 - protein, 6 aa, Artificial Sequence
  synthetic construct
QSISTY

SEQ ID NO: 5380 - protein, 6 aa, Artificial Sequence
  synthetic construct
QSIKNY

SEQ ID NO: 5381 - protein, 9 aa, Artificial Sequence
  synthetic construct
SSNIGAGYD

SEQ ID NO: 5382 - protein, 6 aa, Artificial Sequence
  synthetic construct
NIGSKT

SEQ ID NO: 5383 - protein, 6 aa, Artificial Sequence
  synthetic construct
QDISNW

SEQ ID NO: 5384 - protein, 6 aa, Artificial Sequence
  synthetic construct
ALPNEN

SEQ ID NO: 5385 - protein, 9 aa, Artificial Sequence
  synthetic construct
TSDIGSYDR

SEQ ID NO: 5386 - protein, 8 aa, Artificial Sequence
  synthetic construct
SSNIGNNY

SEQ ID NO: 5387 - protein, 11 aa, Artificial Sequence
  synthetic construct
QSLVYSDGNTY

SEQ ID NO: 5388 - protein, 7 aa, Artificial Sequence
  synthetic construct
QSIRSSY

SEQ ID NO: 5389 - protein, 9 aa, Artificial Sequence
  synthetic construct
TSNIGAGYD

SEQ ID NO: 5390 - protein, 6 aa, Artificial Sequence
  synthetic construct
QSISSY

SEQ ID NO: 5391 - protein, 12 aa, Artificial Sequence
  synthetic construct
QNVLYSSNNKNY

SEQ ID NO: 5392 - protein, 9 aa, Artificial Sequence
  synthetic construct
SSNIGAGYD

SEQ ID NO: 5393 - protein, 8 aa, Artificial Sequence
  synthetic construct
SGSIASSY

SEQ ID NO: 5394 - protein, 6 aa, Artificial Sequence
  synthetic construct
QSISSY

SEQ ID NO: 5395 - protein, 6 aa, Artificial Sequence
  synthetic construct
NIGSKS

SEQ ID NO: 5396 - protein, 9 aa, Artificial Sequence
  synthetic construct
SSDVGGYNY

SEQ ID NO: 5397 - protein, 6 aa, Artificial Sequence
  synthetic construct
QSISSY

SEQ ID NO: 5398 - protein, 6 aa, Artificial Sequence
  synthetic construct
QGINSA

SEQ ID NO: 5399 - protein, 6 aa, Artificial Sequence
  synthetic construct
SLRRYY

SEQ ID NO: 5400 - protein, 6 aa, Artificial Sequence
  synthetic construct
QGIRNW

SEQ ID NO: 5401 - protein, 6 aa, Artificial Sequence
  synthetic construct
QSVGTY

SEQ ID NO: 5402 - protein, 7 aa, Artificial Sequence
  synthetic construct
QSVSSNY

SEQ ID NO: 5403 - protein, 7 aa, Artificial Sequence
  synthetic construct
QSVSSRY

SEQ ID NO: 5404 - protein, 6 aa, Artificial Sequence
  synthetic construct
QSVGSS

SEQ ID NO: 5405 - protein, 6 aa, Artificial Sequence
  synthetic construct
QSISSW

SEQ ID NO: 5406 - protein, 6 aa, Artificial Sequence
  synthetic construct
NIGSKS

SEQ ID NO: 5407 - protein, 6 aa, Artificial Sequence
  synthetic construct
QSVSTY

SEQ ID NO: 5408 - protein, 11 aa, Artificial Sequence
  synthetic construct
QSLLHSNGYNY

SEQ ID NO: 5409 - protein, 6 aa, Artificial Sequence
  synthetic construct
QSISSW

SEQ ID NO: 5410 - protein, 9 aa, Artificial Sequence
  synthetic construct
SGSVSTGNY

SEQ ID NO: 5411 - protein, 7 aa, Artificial Sequence
  synthetic construct
QSVSSSY

SEQ ID NO: 5412 - protein, 6 aa, Artificial Sequence
  synthetic construct
NIGSKS

SEQ ID NO: 5413 - protein, 6 aa, Artificial Sequence
  synthetic construct
QSISRW

SEQ ID NO: 5414 - protein, 6 aa, Artificial Sequence
  synthetic construct
QDIDDD

SEQ ID NO: 5415 - protein, 7 aa, Artificial Sequence
  synthetic construct
QSIGAAY

SEQ ID NO: 5416 - protein, 6 aa, Artificial Sequence
  synthetic construct
ALPKKY

SEQ ID NO: 5417 - protein, 11 aa, Artificial Sequence
  synthetic construct
QSLLHSDGYNY

SEQ ID NO: 5418 - protein, 9 aa, Artificial Sequence
  synthetic construct
SSDVGGYNY

SEQ ID NO: 5419 - protein, 6 aa, Artificial Sequence
  synthetic construct
QSISSN

SEQ ID NO: 5420 - protein, 9 aa, Artificial Sequence
  synthetic construct
SSDVGGYNY

SEQ ID NO: 5421 - protein, 11 aa, Artificial Sequence
  synthetic construct
QRLLHSDGKTY

SEQ ID NO: 5422 - protein, 7 aa, Artificial Sequence
  synthetic construct
QSVSSSF

SEQ ID NO: 5423 - protein, 6 aa, Artificial Sequence
  synthetic construct
QDVDTY

SEQ ID NO: 5424 - protein, 8 aa, Artificial Sequence
  synthetic construct
SSNIGKYS

SEQ ID NO: 5425 - protein, 6 aa, Artificial Sequence
  synthetic construct
QSVGSS

SEQ ID NO: 5426 - protein, 7 aa, Artificial Sequence
  synthetic construct
QSVSSSY

SEQ ID NO: 5427 - protein, 6 aa, Artificial Sequence
  synthetic construct
QSISVW

SEQ ID NO: 5428 - protein, 6 aa, Artificial Sequence
  synthetic construct
SLRRYY

SEQ ID NO: 5429 - protein, 6 aa, Artificial Sequence
  synthetic construct
QSISSY

SEQ ID NO: 5430 - protein, 7 aa, Artificial Sequence
  synthetic construct
QSVSSSY

SEQ ID NO: 5431 - protein, 8 aa, Artificial Sequence
  synthetic construct
SSNIDNNY

SEQ ID NO: 5432 - protein, 6 aa, Artificial Sequence
  synthetic construct
QTISTY

SEQ ID NO: 5433 - protein, 12 aa, Artificial Sequence
  synthetic construct
QTVLHSSNNRNY

SEQ ID NO: 5434 - protein, 6 aa, Artificial Sequence
  synthetic construct
QSVDGN

SEQ ID NO: 5435 - protein, 6 aa, Artificial Sequence
  synthetic construct
QSISNY

SEQ ID NO: 5436 - protein, 9 aa, Artificial Sequence
  synthetic construct
SSNIGAGYD

SEQ ID NO: 5437 - protein, 6 aa, Artificial Sequence
  synthetic construct
QSVSTN

SEQ ID NO: 5438 - protein, 6 aa, Artificial Sequence
  synthetic construct
QSVSGY

SEQ ID NO: 5439 - protein, 8 aa, Artificial Sequence
  synthetic construct
RSNVASHA

SEQ ID NO: 5440 - protein, 12 aa, Artificial Sequence
  synthetic construct
QSLLDSDDGKTY

SEQ ID NO: 5441 - protein, 6 aa, Artificial Sequence
  synthetic construct
KLGDKY

SEQ ID NO: 5442 - protein, 6 aa, Artificial Sequence
  synthetic construct
KLGDIC

SEQ ID NO: 5443 - protein, 12 aa, Artificial Sequence
  synthetic construct
QSLFYSSNNKNY

SEQ ID NO: 5444 - protein, 6 aa, Artificial Sequence
  synthetic construct
QSVSSY

SEQ ID NO: 5445 - protein, 6 aa, Artificial Sequence
  synthetic construct
QSVSNY

SEQ ID NO: 5446 - protein, 11 aa, Artificial Sequence
  synthetic construct
QSLLQSNGNNY

SEQ ID NO: 5447 - protein, 6 aa, Artificial Sequence
  synthetic construct
QSISGW

SEQ ID NO: 5448 - protein, 8 aa, Artificial Sequence
  synthetic construct
SSNIGNNY

SEQ ID NO: 5449 - protein, 6 aa, Artificial Sequence
  synthetic construct
QSVSNY

SEQ ID NO: 5450 - protein, 11 aa, Artificial Sequence
  synthetic construct
QSLLRRDGNNY

SEQ ID NO: 5451 - protein, 9 aa, Artificial Sequence
  synthetic construct
SSDVGGFNY

SEQ ID NO: 5452 - protein, 11 aa, Artificial Sequence
  synthetic construct
QSLVYSDGNTY

SEQ ID NO: 5453 - protein, 6 aa, Artificial Sequence
  synthetic construct
QSISSY

SEQ ID NO: 5454 - protein, 6 aa, Artificial Sequence
  synthetic construct
QDISNY

SEQ ID NO: 5455 - protein, 6 aa, Artificial Sequence
  synthetic construct
NIGSKS

SEQ ID NO: 5456 - protein, 6 aa, Artificial Sequence
  synthetic construct
QVISDY

SEQ ID NO: 5457 - protein, 6 aa, Artificial Sequence
  synthetic construct
QSISTY

SEQ ID NO: 5458 - protein, 6 aa, Artificial Sequence
  synthetic construct
QRISNW

SEQ ID NO: 5459 - protein, 11 aa, Artificial Sequence
  synthetic construct
QSLLNPDGKTY

SEQ ID NO: 5460 - protein, 6 aa, Artificial Sequence
  synthetic construct
QSISGY

SEQ ID NO: 5461 - protein, 9 aa, Artificial Sequence
  synthetic construct
SSNVGADYD

SEQ ID NO: 5462 - protein, 6 aa, Artificial Sequence
  synthetic construct
QSVSSS

SEQ ID NO: 5463 - protein, 7 aa, Artificial Sequence
  synthetic construct
QSFDGKS

SEQ ID NO: 5464 - protein, 12 aa, Artificial Sequence
  synthetic construct
QSILYSSNNKDS

SEQ ID NO: 5465 - protein, 7 aa, Artificial Sequence
  synthetic construct
QSVSGSH

SEQ ID NO: 5466 - protein, 9 aa, Artificial Sequence
  synthetic construct
SSDVGGYNY

SEQ ID NO: 5467 - protein, 6 aa, Artificial Sequence
  synthetic construct
ALPKKY

SEQ ID NO: 5468 - protein, 6 aa, Artificial Sequence
  synthetic construct
QSVSSN

SEQ ID NO: 5469 - protein, 7 aa, Artificial Sequence
  synthetic construct
QSVSSSY

SEQ ID NO: 5470 - protein, 9 aa, Artificial Sequence
  synthetic construct
SSDVGLYNF

SEQ ID NO: 5471 - protein, 9 aa, Artificial Sequence
  synthetic construct
NSNIGAGYY

SEQ ID NO: 5472 - protein, 7 aa, Artificial Sequence
  synthetic construct
QSVTSSY

SEQ ID NO: 5473 - protein, 8 aa, Artificial Sequence
  synthetic construct
SSNIGDNF

SEQ ID NO: 5474 - protein, 6 aa, Artificial Sequence
  synthetic construct
QDIDDD

SEQ ID NO: 5475 - protein, 6 aa, Artificial Sequence
  synthetic construct
QSVGSW

SEQ ID NO: 5476 - protein, 6 aa, Artificial Sequence
  synthetic construct
QDISSF

SEQ ID NO: 5477 - protein, 6 aa, Artificial Sequence
  synthetic construct
SLRDYS

SEQ ID NO: 5478 - protein, 6 aa, Artificial Sequence
  synthetic construct
QSVSAY

SEQ ID NO: 5479 - protein, 6 aa, Artificial Sequence
  synthetic construct
NIGSKS

SEQ ID NO: 5480 - protein, 9 aa, Artificial Sequence
  synthetic construct
SSDVGNYNL

SEQ ID NO: 5481 - protein, 6 aa, Artificial Sequence
  synthetic construct
QSVRSH

SEQ ID NO: 5482 - protein, 6 aa, Artificial Sequence
  synthetic construct
SLRSYY

SEQ ID NO: 5483 - protein, 7 aa, Artificial Sequence
  synthetic construct
QAIVSNY

SEQ ID NO: 5484 - protein, 6 aa, Artificial Sequence
  synthetic construct
NIGKKD

SEQ ID NO: 5485 - protein, 6 aa, Artificial Sequence
  synthetic construct
NIGSKS

SEQ ID NO: 5486 - protein, 6 aa, Artificial Sequence
  synthetic construct
ALPKQS

SEQ ID NO: 5487 - protein, 6 aa, Artificial Sequence
  synthetic construct
ALPKQY

SEQ ID NO: 5488 - protein, 6 aa, Artificial Sequence
  synthetic construct
ALPKKY

SEQ ID NO: 5489 - protein, 6 aa, Artificial Sequence
  synthetic construct
QTIDTY

SEQ ID NO: 5490 - protein, 6 aa, Artificial Sequence
  synthetic construct
QGITNY

SEQ ID NO: 5491 - protein, 6 aa, Artificial Sequence
  synthetic construct
QDISTF

SEQ ID NO: 5492 - protein, 9 aa, Artificial Sequence
  synthetic construct
SSDIGGYNY

SEQ ID NO: 5493 - protein, 6 aa, Artificial Sequence
  synthetic construct
KLGDKY

SEQ ID NO: 5494 - protein, 8 aa, Artificial Sequence
  synthetic construct
TSNIGNNF

SEQ ID NO: 5495 - protein, 7 aa, Artificial Sequence
  synthetic construct
QSISSTY

SEQ ID NO: 5496 - protein, 7 aa, Artificial Sequence
  synthetic construct
QSVSSSY

SEQ ID NO: 5497 - protein, 9 aa, Artificial Sequence
  synthetic construct
SSDVGDYNY

SEQ ID NO: 5498 - protein, 6 aa, Artificial Sequence
  synthetic construct
QFISVY

SEQ ID NO: 5499 - protein, 6 aa, Artificial Sequence
  synthetic construct
QSVSSK

SEQ ID NO: 5500 - protein, 6 aa, Artificial Sequence
  synthetic construct
VLAKNY

SEQ ID NO: 5501 - protein, 9 aa, Artificial Sequence
  synthetic construct
SSDVGAYPY

SEQ ID NO: 5502 - protein, 7 aa, Artificial Sequence
  synthetic construct
QSLSSGY

SEQ ID NO: 5503 - protein, 12 aa, Artificial Sequence
  synthetic construct
QSLLYRSNDKNY

SEQ ID NO: 5504 - protein, 9 aa, Artificial Sequence
  synthetic construct
GSNIGAGYD

SEQ ID NO: 5505 - protein, 9 aa, Artificial Sequence
  synthetic construct
SSDVGGYDH

SEQ ID NO: 5506 - protein, 6 aa, Artificial Sequence
  synthetic construct
QSISSW

SEQ ID NO: 5507 - protein, 6 aa, Artificial Sequence
  synthetic construct
QSIVTN

SEQ ID NO: 5508 - protein, 7 aa, Artificial Sequence
  synthetic construct
SGHSTYA

SEQ ID NO: 5509 - protein, 7 aa, Artificial Sequence
  synthetic construct
QSVSSSY

SEQ ID NO: 5510 - protein, 9 aa, Artificial Sequence
  synthetic construct
SSNLGAGYA

SEQ ID NO: 5511 - protein, 9 aa, Artificial Sequence
  synthetic construct
STNIGTIYD

SEQ ID NO: 5512 - protein, 11 aa, Artificial Sequence
  synthetic construct
QSLLSSNGHHL

SEQ ID NO: 5513 - protein, 6 aa, Artificial Sequence
  synthetic construct
QGISSY

SEQ ID NO: 5514 - protein, 8 aa, Artificial Sequence
  synthetic construct
NSNIGSTF

SEQ ID NO: 5515 - protein, 11 aa, Artificial Sequence
  synthetic construct
QSLLHSNGVYY

SEQ ID NO: 5516 - protein, 6 aa, Artificial Sequence
  synthetic construct
SLRSYF

SEQ ID NO: 5517 - protein, 6 aa, Artificial Sequence
  synthetic construct
QSISSW

SEQ ID NO: 5518 - protein, 12 aa, Artificial Sequence
  synthetic construct
QTVLYDSNNKNY

SEQ ID NO: 5519 - protein, 8 aa, Artificial Sequence
  synthetic construct
SSNIGGKY

SEQ ID NO: 5520 - protein, 6 aa, Artificial Sequence
  synthetic construct
QSISDW

SEQ ID NO: 5521 - protein, 6 aa, Artificial Sequence
  synthetic construct
NPGIKS

SEQ ID NO: 5522 - protein, 9 aa, Artificial Sequence
  synthetic construct
TSNIGADYD

SEQ ID NO: 5523 - protein, 6 aa, Artificial Sequence
  synthetic construct
SLRSFY

SEQ ID NO: 5524 - protein, 9 aa, Artificial Sequence
  synthetic construct
SSDVDGYNY

SEQ ID NO: 5525 - protein, 12 aa, Artificial Sequence
  synthetic construct
QSVLYSSDNKNY

SEQ ID NO: 5526 - protein, 9 aa, Artificial Sequence
  synthetic construct
SSDVGGYNY

SEQ ID NO: 5527 - protein, 6 aa, Artificial Sequence
  synthetic construct
QDISNY

SEQ ID NO: 5528 - protein, 6 aa, Artificial Sequence
  synthetic construct
NIGSKS

SEQ ID NO: 5529 - protein, 7 aa, Artificial Sequence
  synthetic construct
QSVRGNY

SEQ ID NO: 5530 - protein, 8 aa, Artificial Sequence
  synthetic construct
SSNIGSNY

SEQ ID NO: 5531 - protein, 6 aa, Artificial Sequence
  synthetic construct
NIGSYN

SEQ ID NO: 5532 - protein, 7 aa, Artificial Sequence
  synthetic construct
QRVSSNY

SEQ ID NO: 5533 - protein, 9 aa, Artificial Sequence
  synthetic construct
SSDVGSYNL

SEQ ID NO: 5534 - protein, 11 aa, Artificial Sequence
  synthetic construct
QSLVYSDGNTY

SEQ ID NO: 5535 - protein, 8 aa, Artificial Sequence
  synthetic construct
SSNIGSNY

SEQ ID NO: 5536 - protein, 6 aa, Artificial Sequence
  synthetic construct
SLRSYY

SEQ ID NO: 5537 - protein, 6 aa, Artificial Sequence
  synthetic construct
QSISSY

SEQ ID NO: 5538 - protein, 6 aa, Artificial Sequence
  synthetic construct
NIGYRN

SEQ ID NO: 5539 - protein, 6 aa, Artificial Sequence
  synthetic construct
QGIRND

SEQ ID NO: 5540 - protein, 6 aa, Artificial Sequence
  synthetic construct
QSISSW

SEQ ID NO: 5541 - protein, 11 aa, Artificial Sequence
  synthetic construct
QSLLHSNGFNY

SEQ ID NO: 5542 - protein, 6 aa, Artificial Sequence
  synthetic construct
KLGDKY

SEQ ID NO: 5543 - protein, 6 aa, Artificial Sequence
  synthetic construct
ALPKKY

SEQ ID NO: 5544 - protein, 6 aa, Artificial Sequence
  synthetic construct
SLRSYY

SEQ ID NO: 5545 - protein, 12 aa, Artificial Sequence
  synthetic construct
QSVLYSSSSKNY

SEQ ID NO: 5546 - protein, 11 aa, Artificial Sequence
  synthetic construct
QSLLHSNGYNY

SEQ ID NO: 5547 - protein, 9 aa, Artificial Sequence
  synthetic construct
SSDVGGYNY

SEQ ID NO: 5548 - protein, 12 aa, Artificial Sequence
  synthetic construct
QSVLYSSNNKNY

SEQ ID NO: 5549 - protein, 9 aa, Artificial Sequence
  synthetic construct
SSDVGSYNL

SEQ ID NO: 5550 - protein, 6 aa, Artificial Sequence
  synthetic construct
ALPKKY

SEQ ID NO: 5551 - protein, 6 aa, Artificial Sequence
  synthetic construct
QSVSSN

SEQ ID NO: 5552 - protein, 7 aa, Artificial Sequence
  synthetic construct
QSVSSSY

SEQ ID NO: 5553 - protein, 6 aa, Artificial Sequence
  synthetic construct
NIGSRS

SEQ ID NO: 5554 - protein, 9 aa, Artificial Sequence
  synthetic construct
SSDIGTYNL

SEQ ID NO: 5555 - protein, 12 aa, Artificial Sequence
  synthetic construct
QSVLSTSNNKNY

SEQ ID NO: 5556 - protein, 6 aa, Artificial Sequence
  synthetic construct
NIGSKS

SEQ ID NO: 5557 - protein, 6 aa, Artificial Sequence
  synthetic construct
QHIAGR

SEQ ID NO: 5558 - protein, 8 aa, Artificial Sequence
  synthetic construct
SSNIGSNT

SEQ ID NO: 5559 - protein, 8 aa, Artificial Sequence
  synthetic construct
SGSIASNY

SEQ ID NO: 5560 - protein, 9 aa, Artificial Sequence
  synthetic construct
SSNIGAHYD

SEQ ID NO: 5561 - protein, 6 aa, Artificial Sequence
  synthetic construct
QSISSY

SEQ ID NO: 5562 - protein, 6 aa, Artificial Sequence
  synthetic construct
QDISNY

SEQ ID NO: 5563 - protein, 7 aa, Artificial Sequence
  synthetic construct
QDVASTY

SEQ ID NO: 5564 - protein, 9 aa, Artificial Sequence
  synthetic construct
TSDVGTYNL

SEQ ID NO: 5565 - protein, 7 aa, Artificial Sequence
  synthetic construct
QSVANNY

SEQ ID NO: 5566 - protein, 7 aa, Artificial Sequence
  synthetic construct
QSVSSNY

SEQ ID NO: 5567 - protein, 9 aa, Artificial Sequence
  synthetic construct
SGSVSTSFY

SEQ ID NO: 5568 - protein, 9 aa, Artificial Sequence
  synthetic construct
SSNIGAQYD

SEQ ID NO: 5569 - protein, 9 aa, Artificial Sequence
  synthetic construct
SSNIGAGYD

SEQ ID NO: 5570 - protein, 7 aa, Artificial Sequence
  synthetic construct
QSVSSSY

SEQ ID NO: 5571 - protein, 9 aa, Artificial Sequence
  synthetic construct
SSDVGGYNY

SEQ ID NO: 5572 - protein, 9 aa, Artificial Sequence
  synthetic construct
SSDIGGYDL

SEQ ID NO: 5573 - protein, 12 aa, Artificial Sequence
  synthetic construct
QSVLYSSNNKNY

SEQ ID NO: 5574 - protein, 8 aa, Artificial Sequence
  synthetic construct
SSNIGSNT

SEQ ID NO: 5575 - protein, 9 aa, Artificial Sequence
  synthetic construct
TGVVTTGHY

SEQ ID NO: 5576 - protein, 9 aa, Artificial Sequence
  synthetic construct
YSNIGAGYD

SEQ ID NO: 5577 - protein, 6 aa, Artificial Sequence
  synthetic construct
QNINRF

SEQ ID NO: 5578 - protein, 6 aa, Artificial Sequence
  synthetic construct
QGIRND

SEQ ID NO: 5579 - protein, 6 aa, Artificial Sequence
  synthetic construct
SLRTDY

SEQ ID NO: 5580 - protein, 12 aa, Artificial Sequence
  synthetic construct
QSVLSSYNNKDY

SEQ ID NO: 5581 - protein, 11 aa, Artificial Sequence
  synthetic construct
QSLVYSDGNTY

SEQ ID NO: 5582 - protein, 6 aa, Artificial Sequence
  synthetic construct
ALPKKY

SEQ ID NO: 5583 - protein, 6 aa, Artificial Sequence
  synthetic construct
NIGSKS

SEQ ID NO: 5584 - protein, 6 aa, Artificial Sequence
  synthetic construct
QSISTY

SEQ ID NO: 5585 - protein, 6 aa, Artificial Sequence
  synthetic construct
QSVGSD

SEQ ID NO: 5586 - protein, 12 aa, Artificial Sequence
  synthetic construct
QSVLYSSNNKNY

SEQ ID NO: 5587 - protein, 6 aa, Artificial Sequence
  synthetic construct
ALAKEY

SEQ ID NO: 5588 - protein, 6 aa, Artificial Sequence
  synthetic construct
QNIRDF

SEQ ID NO: 5589 - protein, 12 aa, Artificial Sequence
  synthetic construct
QTILYSSNNKNY

SEQ ID NO: 5590 - protein, 6 aa, Artificial Sequence
  synthetic construct
KLGNKY

SEQ ID NO: 5591 - protein, 8 aa, Artificial Sequence
  synthetic construct
RSNIGSNF

SEQ ID NO: 5592 - protein, 8 aa, Artificial Sequence
  synthetic construct
SSNIGNNY

SEQ ID NO: 5593 - protein, 6 aa, Artificial Sequence
  synthetic construct
QSVSFW

SEQ ID NO: 5594 - protein, 12 aa, Artificial Sequence
  synthetic construct
QSVFYSSNNKNY

SEQ ID NO: 5595 - protein, 12 aa, Artificial Sequence
  synthetic construct
QSVLYSSNNKNY

SEQ ID NO: 5596 - protein, 9 aa, Artificial Sequence
  synthetic construct
SNDIGRYKY

SEQ ID NO: 5597 - protein, 11 aa, Artificial Sequence
  synthetic construct
QSLVYSDGNTY

SEQ ID NO: 5598 - protein, 6 aa, Artificial Sequence
  synthetic construct
KLGDKY

SEQ ID NO: 5599 - protein, 7 aa, Artificial Sequence
  synthetic construct
QRVNSNY

SEQ ID NO: 5600 - protein, 6 aa, Artificial Sequence
  synthetic construct
NLGNKY

SEQ ID NO: 5601 - protein, 11 aa, Artificial Sequence
  synthetic construct
QSLLHSNGYNY

SEQ ID NO: 5602 - protein, 8 aa, Artificial Sequence
  synthetic construct
SSNIGNNY

SEQ ID NO: 5603 - protein, 6 aa, Artificial Sequence
  synthetic construct
QSISSW

SEQ ID NO: 5604 - protein, 6 aa, Artificial Sequence
  synthetic construct
QSISSW

SEQ ID NO: 5605 - protein, 9 aa, Artificial Sequence
  synthetic construct
SSNIGAGYD

SEQ ID NO: 5606 - protein, 6 aa, Artificial Sequence
  synthetic construct
ALPKQY

SEQ ID NO: 5607 - protein, 6 aa, Artificial Sequence
  synthetic construct
QNIRNN

SEQ ID NO: 5608 - protein, 6 aa, Artificial Sequence
  synthetic construct
QSVSSN

SEQ ID NO: 5609 - protein, 6 aa, Artificial Sequence
  synthetic construct
QSISSY

SEQ ID NO: 5610 - protein, 6 aa, Artificial Sequence
  synthetic construct
QSISTY

SEQ ID NO: 5611 - protein, 7 aa, Artificial Sequence
  synthetic construct
QSVTSSY

SEQ ID NO: 5612 - protein, 6 aa, Artificial Sequence
  synthetic construct
NIGSKS

SEQ ID NO: 5613 - protein, 8 aa, Artificial Sequence
  synthetic construct
SGSIADKY

SEQ ID NO: 5614 - protein, 11 aa, Artificial Sequence
  synthetic construct
QSLLHSNGYNY

SEQ ID NO: 5615 - protein, 6 aa, Artificial Sequence
  synthetic construct
QSISSW

SEQ ID NO: 5616 - protein, 11 aa, Artificial Sequence
  synthetic construct
QSLLYRDGEHY

SEQ ID NO: 5617 - protein, 6 aa, Artificial Sequence
  synthetic construct
QSISSY

SEQ ID NO: 5618 - protein, 12 aa, Artificial Sequence
  synthetic construct
QSLLYSSNYKNY

SEQ ID NO: 5619 - protein, 8 aa, Artificial Sequence
  synthetic construct
SSNIGSNY

SEQ ID NO: 5620 - protein, 9 aa, Artificial Sequence
  synthetic construct
SSDVGGYNY

SEQ ID NO: 5621 - protein, 9 aa, Artificial Sequence
  synthetic construct
NSNIGAGYD

SEQ ID NO: 5622 - protein, 9 aa, Artificial Sequence
  synthetic construct
SDINVTNYN

SEQ ID NO: 5623 - protein, 11 aa, Artificial Sequence
  synthetic construct
QSLLHSDGYNY

SEQ ID NO: 5624 - protein, 6 aa, Artificial Sequence
  synthetic construct
QGIRND

SEQ ID NO: 5625 - protein, 11 aa, Artificial Sequence
  synthetic construct
QSLLHSDGKTY

SEQ ID NO: 5626 - protein, 8 aa, Artificial Sequence
  synthetic construct
MSGGGGSI

SEQ ID NO: 5627 - protein, 8 aa, Artificial Sequence
  synthetic construct
IKQDGSEK

SEQ ID NO: 5628 - protein, 8 aa, Artificial Sequence
  synthetic construct
ISWNSGNI

SEQ ID NO: 5629 - protein, 7 aa, Artificial Sequence
  synthetic construct
IYWDDDK

SEQ ID NO: 5630 - protein, 8 aa, Artificial Sequence
  synthetic construct
INTSGGST

SEQ ID NO: 5631 - protein, 8 aa, Artificial Sequence
  synthetic construct
ISWNSVSI

SEQ ID NO: 5632 - protein, 8 aa, Artificial Sequence
  synthetic construct
ITTYNRDT

SEQ ID NO: 5633 - protein, 8 aa, Artificial Sequence
  synthetic construct
ISGDGGGT

SEQ ID NO: 5634 - protein, 8 aa, Artificial Sequence
  synthetic construct
IRYDGRNK

SEQ ID NO: 5635 - protein, 8 aa, Artificial Sequence
  synthetic construct
IGWDSGGI

SEQ ID NO: 5636 - protein, 8 aa, Artificial Sequence
  synthetic construct
ISIYSGNT

SEQ ID NO: 5637 - protein, 8 aa, Artificial Sequence
  synthetic construct
ISSDGRKI

SEQ ID NO: 5638 - protein, 8 aa, Artificial Sequence
  synthetic construct
ISATTGST

SEQ ID NO: 5639 - protein, 9 aa, Artificial Sequence
  synthetic construct
TYYRSKWYN

SEQ ID NO: 5640 - protein, 8 aa, Artificial Sequence
  synthetic construct
IHYDGRNK

SEQ ID NO: 5641 - protein, 8 aa, Artificial Sequence
  synthetic construct
ISSSSSSI

SEQ ID NO: 5642 - protein, 8 aa, Artificial Sequence
  synthetic construct
ISAYNGNT

SEQ ID NO: 5643 - protein, 8 aa, Artificial Sequence
  synthetic construct
IGIGGNTI

SEQ ID NO: 5644 - protein, 8 aa, Artificial Sequence
  synthetic construct
INAGNGNT

SEQ ID NO: 5645 - protein, 7 aa, Artificial Sequence
  synthetic construct
VYHSGNA

SEQ ID NO: 5646 - protein, 7 aa, Artificial Sequence
  synthetic construct
IYWDDDE

SEQ ID NO: 5647 - protein, 8 aa, Artificial Sequence
  synthetic construct
ISWGSSYI

SEQ ID NO: 5648 - protein, 8 aa, Artificial Sequence
  synthetic construct
ISSSSRYI

SEQ ID NO: 5649 - protein, 7 aa, Artificial Sequence
  synthetic construct
IYYSGNR

SEQ ID NO: 5650 - protein, 7 aa, Artificial Sequence
  synthetic construct
IYTSGNT

SEQ ID NO: 5651 - protein, 8 aa, Artificial Sequence
  synthetic construct
ISSKSSSK

SEQ ID NO: 5652 - protein, 7 aa, Artificial Sequence
  synthetic construct
IYYRGTT

SEQ ID NO: 5653 - protein, 7 aa, Artificial Sequence
  synthetic construct
IWYDGSN

SEQ ID NO: 5654 - protein, 7 aa, Artificial Sequence
  synthetic construct
MYTSGST

SEQ ID NO: 5655 - protein, 8 aa, Artificial Sequence
  synthetic construct
INPNSGGT

SEQ ID NO: 5656 - protein, 7 aa, Artificial Sequence
  synthetic construct
IHHTGSA

SEQ ID NO: 5657 - protein, 7 aa, Artificial Sequence
  synthetic construct
IYYSGDT

SEQ ID NO: 5658 - protein, 8 aa, Artificial Sequence
  synthetic construct
ISHDGSNK

SEQ ID NO: 5659 - protein, 7 aa, Artificial Sequence
  synthetic construct
IYWDDDK

SEQ ID NO: 5660 - protein, 8 aa, Artificial Sequence
  synthetic construct
INTTSDPI

SEQ ID NO: 5661 - protein, 8 aa, Artificial Sequence
  synthetic construct
IIPIFGTA

SEQ ID NO: 5662 - protein, 7 aa, Artificial Sequence
  synthetic construct
IYFSVTT

SEQ ID NO: 5663 - protein, 7 aa, Artificial Sequence
  synthetic construct
LSYSGNT

SEQ ID NO: 5664 - protein, 8 aa, Artificial Sequence
  synthetic construct
INAGNGDI

SEQ ID NO: 5665 - protein, 8 aa, Artificial Sequence
  synthetic construct
ISGSGHST

SEQ ID NO: 5666 - protein, 8 aa, Artificial Sequence
  synthetic construct
INWNGGST

SEQ ID NO: 5667 - protein, 8 aa, Artificial Sequence
  synthetic construct
ISYDGSNK

SEQ ID NO: 5668 - protein, 7 aa, Artificial Sequence
  synthetic construct
IYYSGST

SEQ ID NO: 5669 - protein, 8 aa, Artificial Sequence
  synthetic construct
INPNSGGT

SEQ ID NO: 5670 - protein, 7 aa, Artificial Sequence
  synthetic construct
IGTAGDT

SEQ ID NO: 5671 - protein, 8 aa, Artificial Sequence
  synthetic construct
ISYDGSNS

SEQ ID NO: 5672 - protein, 8 aa, Artificial Sequence
  synthetic construct
MSSGGNRR

SEQ ID NO: 5673 - protein, 8 aa, Artificial Sequence
  synthetic construct
ISSSGTYI

SEQ ID NO: 5674 - protein, 8 aa, Artificial Sequence
  synthetic construct
ISYDGSNK

SEQ ID NO: 5675 - protein, 8 aa, Artificial Sequence
  synthetic construct
ISWNSGSI

SEQ ID NO: 5676 - protein, 7 aa, Artificial Sequence
  synthetic construct
IYYSGST

SEQ ID NO: 5677 - protein, 8 aa, Artificial Sequence
  synthetic construct
IIPIFGTA

SEQ ID NO: 5678 - protein, 8 aa, Artificial Sequence
  synthetic construct
INGYNGNT

SEQ ID NO: 5679 - protein, 8 aa, Artificial Sequence
  synthetic construct
ITSSGDTI

SEQ ID NO: 5680 - protein, 8 aa, Artificial Sequence
  synthetic construct
IIPIFGTT

SEQ ID NO: 5681 - protein, 8 aa, Artificial Sequence
  synthetic construct
IYPGDSDT

SEQ ID NO: 5682 - protein, 8 aa, Artificial Sequence
  synthetic construct
TWYEGTNE

SEQ ID NO: 5683 - protein, 8 aa, Artificial Sequence
  synthetic construct
MSGSGAGT

SEQ ID NO: 5684 - protein, 8 aa, Artificial Sequence
  synthetic construct
ISYDGGTK

SEQ ID NO: 5685 - protein, 8 aa, Artificial Sequence
  synthetic construct
IWYDGSTK

SEQ ID NO: 5686 - protein, 7 aa, Artificial Sequence
  synthetic construct
IYFTGST

SEQ ID NO: 5687 - protein, 8 aa, Artificial Sequence
  synthetic construct
IYPGDSDT

SEQ ID NO: 5688 - protein, 7 aa, Artificial Sequence
  synthetic construct
IYTSGST

SEQ ID NO: 5689 - protein, 9 aa, Artificial Sequence
  synthetic construct
THYRSKWYN

SEQ ID NO: 5690 - protein, 8 aa, Artificial Sequence
  synthetic construct
FDPEDGET

SEQ ID NO: 5691 - protein, 8 aa, Artificial Sequence
  synthetic construct
ISSSSSYI

SEQ ID NO: 5692 - protein, 8 aa, Artificial Sequence
  synthetic construct
ISGSGGST

SEQ ID NO: 5693 - protein, 8 aa, Artificial Sequence
  synthetic construct
ITPIFNIT

SEQ ID NO: 5694 - protein, 7 aa, Artificial Sequence
  synthetic construct
IYYSGST

SEQ ID NO: 5695 - protein, 8 aa, Artificial Sequence
  synthetic construct
ITYDGQIK

SEQ ID NO: 5696 - protein, 7 aa, Artificial Sequence
  synthetic construct
IYYSGTT

SEQ ID NO: 5697 - protein, 8 aa, Artificial Sequence
  synthetic construct
ISWNSGSI

SEQ ID NO: 5698 - protein, 7 aa, Artificial Sequence
  synthetic construct
IYSSGDT

SEQ ID NO: 5699 - protein, 7 aa, Artificial Sequence
  synthetic construct
IYWDDDE

SEQ ID NO: 5700 - protein, 8 aa, Artificial Sequence
  synthetic construct
VSSSGSTM

SEQ ID NO: 5701 - protein, 8 aa, Artificial Sequence
  synthetic construct
IDPSDSYT

SEQ ID NO: 5702 - protein, 8 aa, Artificial Sequence
  synthetic construct
IFPADSDT

SEQ ID NO: 5703 - protein, 7 aa, Artificial Sequence
  synthetic construct
IFYSGIT

SEQ ID NO: 5704 - protein, 8 aa, Artificial Sequence
  synthetic construct
IIPIFGTS

SEQ ID NO: 5705 - protein, 8 aa, Artificial Sequence
  synthetic construct
ITWDGSII

SEQ ID NO: 5706 - protein, 8 aa, Artificial Sequence
  synthetic construct
INAYQGVT

SEQ ID NO: 5707 - protein, 8 aa, Artificial Sequence
  synthetic construct
IKEDGSEK

SEQ ID NO: 5708 - protein, 7 aa, Artificial Sequence
  synthetic construct
ISYNGNT

SEQ ID NO: 5709 - protein, 6 aa, Artificial Sequence
  synthetic construct
IGSSGT

SEQ ID NO: 5710 - protein, 8 aa, Artificial Sequence
  synthetic construct
ISGLGNSI

SEQ ID NO: 5711 - protein, 8 aa, Artificial Sequence
  synthetic construct
ISDDGNDK

SEQ ID NO: 5712 - protein, 8 aa, Artificial Sequence
  synthetic construct
ISWDGGST

SEQ ID NO: 5713 - protein, 8 aa, Artificial Sequence
  synthetic construct
INTNNGKT

SEQ ID NO: 5714 - protein, 8 aa, Artificial Sequence
  synthetic construct
IDWSGKTT

SEQ ID NO: 5715 - protein, 8 aa, Artificial Sequence
  synthetic construct
ISGSGGST

SEQ ID NO: 5716 - protein, 8 aa, Artificial Sequence
  synthetic construct
VSYDGTNK

SEQ ID NO: 5717 - protein, 8 aa, Artificial Sequence
  synthetic construct
ITSTSSYL

SEQ ID NO: 5718 - protein, 7 aa, Artificial Sequence
  synthetic construct
IYTSGST

SEQ ID NO: 5719 - protein, 7 aa, Artificial Sequence
  synthetic construct
VYYSGRT

SEQ ID NO: 5720 - protein, 8 aa, Artificial Sequence
  synthetic construct
VSYDGTNK

SEQ ID NO: 5721 - protein, 8 aa, Artificial Sequence
  synthetic construct
IYPVDSDT

SEQ ID NO: 5722 - protein, 8 aa, Artificial Sequence
  synthetic construct
TGGSGYTK

SEQ ID NO: 5723 - protein, 8 aa, Artificial Sequence
  synthetic construct
ISSSGSTI

SEQ ID NO: 5724 - protein, 8 aa, Artificial Sequence
  synthetic construct
IKEDGSEK

SEQ ID NO: 5725 - protein, 7 aa, Artificial Sequence
  synthetic construct
IYYSGST

SEQ ID NO: 5726 - protein, 8 aa, Artificial Sequence
  synthetic construct
ISYDGSNK

SEQ ID NO: 5727 - protein, 8 aa, Artificial Sequence
  synthetic construct
IGSSTTAI

SEQ ID NO: 5728 - protein, 7 aa, Artificial Sequence
  synthetic construct
ISYSGST

SEQ ID NO: 5729 - protein, 7 aa, Artificial Sequence
  synthetic construct
IYYSGST

SEQ ID NO: 5730 - protein, 7 aa, Artificial Sequence
  synthetic construct
ISYSGST

SEQ ID NO: 5731 - protein, 8 aa, Artificial Sequence
  synthetic construct
IKQDGSEK

SEQ ID NO: 5732 - protein, 8 aa, Artificial Sequence
  synthetic construct
ISWNSGSI

SEQ ID NO: 5733 - protein, 8 aa, Artificial Sequence
  synthetic construct
IYPGDSDT

SEQ ID NO: 5734 - protein, 9 aa, Artificial Sequence
  synthetic construct
TYYRSQWMN

SEQ ID NO: 5735 - protein, 9 aa, Artificial Sequence
  synthetic construct
TYYRSKWYN

SEQ ID NO: 5736 - protein, 7 aa, Artificial Sequence
  synthetic construct
LFYSGST

SEQ ID NO: 5737 - protein, 8 aa, Artificial Sequence
  synthetic construct
IYPGDSDT

SEQ ID NO: 5738 - protein, 8 aa, Artificial Sequence
  synthetic construct
IWYDGSNK

SEQ ID NO: 5739 - protein, 8 aa, Artificial Sequence
  synthetic construct
ISSSSRYV

SEQ ID NO: 5740 - protein, 8 aa, Artificial Sequence
  synthetic construct
IIPILNIT

SEQ ID NO: 5741 - protein, 8 aa, Artificial Sequence
  synthetic construct
ISSTSNYI

SEQ ID NO: 5742 - protein, 8 aa, Artificial Sequence
  synthetic construct
ISYDGSDE

SEQ ID NO: 5743 - protein, 8 aa, Artificial Sequence
  synthetic construct
IWHDGSHK

SEQ ID NO: 5744 - protein, 8 aa, Artificial Sequence
  synthetic construct
ISGDGRST

SEQ ID NO: 5745 - protein, 8 aa, Artificial Sequence
  synthetic construct
ISDDGKNK

SEQ ID NO: 5746 - protein, 8 aa, Artificial Sequence
  synthetic construct
IKQDGSEK

SEQ ID NO: 5747 - protein, 8 aa, Artificial Sequence
  synthetic construct
ISSDGSTT

SEQ ID NO: 5748 - protein, 10 aa, Artificial Sequence
  synthetic construct
IRSKTDGGTT

SEQ ID NO: 5749 - protein, 7 aa, Artificial Sequence
  synthetic construct
ISDIGDT

SEQ ID NO: 5750 - protein, 8 aa, Artificial Sequence
  synthetic construct
IIPIFGTA

SEQ ID NO: 5751 - protein, 7 aa, Artificial Sequence
  synthetic construct
IYFSGKT

SEQ ID NO: 5752 - protein, 8 aa, Artificial Sequence
  synthetic construct
INRDGSYT

SEQ ID NO: 5753 - protein, 7 aa, Artificial Sequence
  synthetic construct
VYYSGST

SEQ ID NO: 5754 - protein, 7 aa, Artificial Sequence
  synthetic construct
VSPSGTN

SEQ ID NO: 5755 - protein, 8 aa, Artificial Sequence
  synthetic construct
IIPIVGEA

SEQ ID NO: 5756 - protein, 8 aa, Artificial Sequence
  synthetic construct
INSDGSST

SEQ ID NO: 5757 - protein, 7 aa, Artificial Sequence
  synthetic construct
IYYNGST

SEQ ID NO: 5758 - protein, 8 aa, Artificial Sequence
  synthetic construct
ISGSGGST

SEQ ID NO: 5759 - protein, 8 aa, Artificial Sequence
  synthetic construct
ISASGRTT

SEQ ID NO: 5760 - protein, 8 aa, Artificial Sequence
  synthetic construct
ITANGGST

SEQ ID NO: 5761 - protein, 7 aa, Artificial Sequence
  synthetic construct
IYHRGTS

SEQ ID NO: 5762 - protein, 8 aa, Artificial Sequence
  synthetic construct
ISFDGSNQ

SEQ ID NO: 5763 - protein, 8 aa, Artificial Sequence
  synthetic construct
IDPSGGSR

SEQ ID NO: 5764 - protein, 8 aa, Artificial Sequence
  synthetic construct
INTDGSST

SEQ ID NO: 5765 - protein, 8 aa, Artificial Sequence
  synthetic construct
FDPEGGET

SEQ ID NO: 5766 - protein, 7 aa, Artificial Sequence
  synthetic construct
IYYNGDT

SEQ ID NO: 5767 - protein, 8 aa, Artificial Sequence
  synthetic construct
ISAYTGNT

SEQ ID NO: 5768 - protein, 8 aa, Artificial Sequence
  synthetic construct
IIWNSGTT

SEQ ID NO: 5769 - protein, 8 aa, Artificial Sequence
  synthetic construct
INTDGSRG

SEQ ID NO: 5770 - protein, 7 aa, Artificial Sequence
  synthetic construct
IYHSGST

SEQ ID NO: 5771 - protein, 10 aa, Artificial Sequence
  synthetic construct
IKSKSDGGST

SEQ ID NO: 5772 - protein, 7 aa, Artificial Sequence
  synthetic construct
IYSGGTT

SEQ ID NO: 5773 - protein, 10 aa, Artificial Sequence
  synthetic construct
IKNRANSYNT

SEQ ID NO: 5774 - protein, 8 aa, Artificial Sequence
  synthetic construct
ISFDGSDK

SEQ ID NO: 5775 - protein, 8 aa, Artificial Sequence
  synthetic construct
ITAGGSFI

SEQ ID NO: 5776 - protein, 8 aa, Artificial Sequence
  synthetic construct
INPNSGGT

SEQ ID NO: 5777 - protein, 8 aa, Artificial Sequence
  synthetic construct
ISYSGGST

SEQ ID NO: 5778 - protein, 8 aa, Artificial Sequence
  synthetic construct
ISSSGGDI

SEQ ID NO: 5779 - protein, 8 aa, Artificial Sequence
  synthetic construct
ISWNSGDI

SEQ ID NO: 5780 - protein, 8 aa, Artificial Sequence
  synthetic construct
IGGSGGYT

SEQ ID NO: 5781 - protein, 7 aa, Artificial Sequence
  synthetic construct
IFHSGSA

SEQ ID NO: 5782 - protein, 8 aa, Artificial Sequence
  synthetic construct
MITTFGKA

SEQ ID NO: 5783 - protein, 7 aa, Artificial Sequence
  synthetic construct
IYYSGST

SEQ ID NO: 5784 - protein, 8 aa, Artificial Sequence
  synthetic construct
ISAYNGNT

SEQ ID NO: 5785 - protein, 8 aa, Artificial Sequence
  synthetic construct
INTVTGIP

SEQ ID NO: 5786 - protein, 7 aa, Artificial Sequence
  synthetic construct
VYYSGST

SEQ ID NO: 5787 - protein, 8 aa, Artificial Sequence
  synthetic construct
IAYDGSQK

SEQ ID NO: 5788 - protein, 8 aa, Artificial Sequence
  synthetic construct
IIPVFGTT

SEQ ID NO: 5789 - protein, 8 aa, Artificial Sequence
  synthetic construct
INAGNGDT

SEQ ID NO: 5790 - protein, 7 aa, Artificial Sequence
  synthetic construct
IYHSGST

SEQ ID NO: 5791 - protein, 8 aa, Artificial Sequence
  synthetic construct
VEGYRSEE

SEQ ID NO: 5792 - protein, 8 aa, Artificial Sequence
  synthetic construct
ISASGGGT

SEQ ID NO: 5793 - protein, 7 aa, Artificial Sequence
  synthetic construct
IYYSGTS

SEQ ID NO: 5794 - protein, 8 aa, Artificial Sequence
  synthetic construct
INPKTGDT

SEQ ID NO: 5795 - protein, 8 aa, Artificial Sequence
  synthetic construct
ISYDGSNK

SEQ ID NO: 5796 - protein, 8 aa, Artificial Sequence
  synthetic construct
ISSSSSYI

SEQ ID NO: 5797 - protein, 7 aa, Artificial Sequence
  synthetic construct
IYYSGST

SEQ ID NO: 5798 - protein, 10 aa, Artificial Sequence
  synthetic construct
IKSKTDGGTT

SEQ ID NO: 5799 - protein, 8 aa, Artificial Sequence
  synthetic construct
INPSFGST

SEQ ID NO: 5800 - protein, 8 aa, Artificial Sequence
  synthetic construct
IMPMFGRT

SEQ ID NO: 5801 - protein, 8 aa, Artificial Sequence
  synthetic construct
ISSTGTTT

SEQ ID NO: 5802 - protein, 8 aa, Artificial Sequence
  synthetic construct
ISNDGSNK

SEQ ID NO: 5803 - protein, 8 aa, Artificial Sequence
  synthetic construct
IYPGDSDT

SEQ ID NO: 5804 - protein, 8 aa, Artificial Sequence
  synthetic construct
ISRGSSVI

SEQ ID NO: 5805 - protein, 7 aa, Artificial Sequence
  synthetic construct
IFSNDEK

SEQ ID NO: 5806 - protein, 8 aa, Artificial Sequence
  synthetic construct
INPNSGGT

SEQ ID NO: 5807 - protein, 8 aa, Artificial Sequence
  synthetic construct
ISAYNGNT

SEQ ID NO: 5808 - protein, 9 aa, Artificial Sequence
  synthetic construct
TFYRTKWYS

SEQ ID NO: 5809 - protein, 7 aa, Artificial Sequence
  synthetic construct
ICHSGST

SEQ ID NO: 5810 - protein, 7 aa, Artificial Sequence
  synthetic construct
IYSGGST

SEQ ID NO: 5811 - protein, 8 aa, Artificial Sequence
  synthetic construct
INPNGGTT

SEQ ID NO: 5812 - protein, 7 aa, Artificial Sequence
  synthetic construct
IYYSGST

SEQ ID NO: 5813 - protein, 7 aa, Artificial Sequence
  synthetic construct
IHYTGST

SEQ ID NO: 5814 - protein, 8 aa, Artificial Sequence
  synthetic construct
ISYDGSNK

SEQ ID NO: 5815 - protein, 8 aa, Artificial Sequence
  synthetic construct
ISGSGGST

SEQ ID NO: 5816 - protein, 7 aa, Artificial Sequence
  synthetic construct
IYYSGST

SEQ ID NO: 5817 - protein, 8 aa, Artificial Sequence
  synthetic construct
INPNSGGT

SEQ ID NO: 5818 - protein, 8 aa, Artificial Sequence
  synthetic construct
INPADSDT

SEQ ID NO: 5819 - protein, 8 aa, Artificial Sequence
  synthetic construct
IYPADSDT

SEQ ID NO: 5820 - protein, 8 aa, Artificial Sequence
  synthetic construct
ISYSGNTT

SEQ ID NO: 5821 - protein, 8 aa, Artificial Sequence
  synthetic construct
INPGGGST

SEQ ID NO: 5822 - protein, 8 aa, Artificial Sequence
  synthetic construct
ITSPGGHT

SEQ ID NO: 5823 - protein, 8 aa, Artificial Sequence
  synthetic construct
ISGSGGST

SEQ ID NO: 5824 - protein, 8 aa, Artificial Sequence
  synthetic construct
INPVNGVT

SEQ ID NO: 5825 - protein, 8 aa, Artificial Sequence
  synthetic construct
INTNTGNP

SEQ ID NO: 5826 - protein, 8 aa, Artificial Sequence
  synthetic construct
ISSDGSNK

SEQ ID NO: 5827 - protein, 8 aa, Artificial Sequence
  synthetic construct
VSGSGFTT

SEQ ID NO: 5828 - protein, 8 aa, Artificial Sequence
  synthetic construct
ISSSSSYI

SEQ ID NO: 5829 - protein, 7 aa, Artificial Sequence
  synthetic construct
INWDDDK

SEQ ID NO: 5830 - protein, 7 aa, Artificial Sequence
  synthetic construct
IYWDDDT

SEQ ID NO: 5831 - protein, 7 aa, Artificial Sequence
  synthetic construct
IYYIGTT

SEQ ID NO: 5832 - protein, 8 aa, Artificial Sequence
  synthetic construct
INQDGGEK

SEQ ID NO: 5833 - protein, 8 aa, Artificial Sequence
  synthetic construct
IIPVFGPP

SEQ ID NO: 5834 - protein, 8 aa, Artificial Sequence
  synthetic construct
IVPIFDTT

SEQ ID NO: 5835 - protein, 8 aa, Artificial Sequence
  synthetic construct
INAGNGNT

SEQ ID NO: 5836 - protein, 8 aa, Artificial Sequence
  synthetic construct
ISPYNGNI

SEQ ID NO: 5837 - protein, 8 aa, Artificial Sequence
  synthetic construct
ISGPGESS

SEQ ID NO: 5838 - protein, 8 aa, Artificial Sequence
  synthetic construct
INPSGGYT

SEQ ID NO: 5839 - protein, 8 aa, Artificial Sequence
  synthetic construct
VFPGDSDI

SEQ ID NO: 5840 - protein, 8 aa, Artificial Sequence
  synthetic construct
IWYDGTNK

SEQ ID NO: 5841 - protein, 8 aa, Artificial Sequence
  synthetic construct
IDPSDSYT

SEQ ID NO: 5842 - protein, 8 aa, Artificial Sequence
  synthetic construct
ISGDGTRT

SEQ ID NO: 5843 - protein, 8 aa, Artificial Sequence
  synthetic construct
TYHRTTTT

SEQ ID NO: 5844 - protein, 8 aa, Artificial Sequence
  synthetic construct
ITPNSGTP

SEQ ID NO: 5845 - protein, 10 aa, Artificial Sequence
  synthetic construct
IRSKAYGGTR

SEQ ID NO: 5846 - protein, 8 aa, Artificial Sequence
  synthetic construct
ISGYNGRT

SEQ ID NO: 5847 - protein, 8 aa, Artificial Sequence
  synthetic construct
MNADGSEK

SEQ ID NO: 5848 - protein, 8 aa, Artificial Sequence
  synthetic construct
ISSSSSTI

SEQ ID NO: 5849 - protein, 7 aa, Artificial Sequence
  synthetic construct
IYYSGST

SEQ ID NO: 5850 - protein, 7 aa, Artificial Sequence
  synthetic construct
MFYGGST

SEQ ID NO: 5851 - protein, 8 aa, Artificial Sequence
  synthetic construct
IWYDGSNE

SEQ ID NO: 5852 - protein, 8 aa, Artificial Sequence
  synthetic construct
ISTDSGNT

SEQ ID NO: 5853 - protein, 8 aa, Artificial Sequence
  synthetic construct
IHWNGGST

SEQ ID NO: 5854 - protein, 8 aa, Artificial Sequence
  synthetic construct
MWYDGNNK

SEQ ID NO: 5855 - protein, 8 aa, Artificial Sequence
  synthetic construct
ISGSGGRT

SEQ ID NO: 5856 - protein, 10 aa, Artificial Sequence
  synthetic construct
IKTKTDGGTT

SEQ ID NO: 5857 - protein, 8 aa, Artificial Sequence
  synthetic construct
IWHDGSKT

SEQ ID NO: 5858 - protein, 8 aa, Artificial Sequence
  synthetic construct
ISPYTRQT

SEQ ID NO: 5859 - protein, 8 aa, Artificial Sequence
  synthetic construct
TRFDGSEK

SEQ ID NO: 5860 - protein, 8 aa, Artificial Sequence
  synthetic construct
ISHDGSNN

SEQ ID NO: 5861 - protein, 8 aa, Artificial Sequence
  synthetic construct
IHVGNDHT

SEQ ID NO: 5862 - protein, 8 aa, Artificial Sequence
  synthetic construct
FDPSDSYN

SEQ ID NO: 5863 - protein, 7 aa, Artificial Sequence
  synthetic construct
IYWDDDK

SEQ ID NO: 5864 - protein, 8 aa, Artificial Sequence
  synthetic construct
ISGDSRDI

SEQ ID NO: 5865 - protein, 8 aa, Artificial Sequence
  synthetic construct
IIPVLGIP

SEQ ID NO: 5866 - protein, 7 aa, Artificial Sequence
  synthetic construct
VYYSGNT

SEQ ID NO: 5867 - protein, 8 aa, Artificial Sequence
  synthetic construct
ISSNGGST

SEQ ID NO: 5868 - protein, 8 aa, Artificial Sequence
  synthetic construct
ISSSRSTI

SEQ ID NO: 5869 - protein, 7 aa, Artificial Sequence
  synthetic construct
IIHTGTT

SEQ ID NO: 5870 - protein, 8 aa, Artificial Sequence
  synthetic construct
INTDGTVT

SEQ ID NO: 5871 - protein, 7 aa, Artificial Sequence
  synthetic construct
IYWDDDK

SEQ ID NO: 5872 - protein, 8 aa, Artificial Sequence
  synthetic construct
ISYDGSNK

SEQ ID NO: 5873 - protein, 8 aa, Artificial Sequence
  synthetic construct
ISSSGSTI

SEQ ID NO: 5874 - protein, 8 aa, Artificial Sequence
  synthetic construct
ISSSSSTI

SEQ ID NO: 5875 - protein, 7 aa, Artificial Sequence
  synthetic construct
IDWDDDK

SEQ ID NO: 5876 - protein, 8 aa, Artificial Sequence
  synthetic construct
IKQDGSEK

SEQ ID NO: 5877 - protein, 8 aa, Artificial Sequence
  synthetic construct
FVGSGDTT

SEQ ID NO: 5878 - protein, 8 aa, Artificial Sequence
  synthetic construct
ISSSSSTK

SEQ ID NO: 5879 - protein, 8 aa, Artificial Sequence
  synthetic construct
INPKTGAT

SEQ ID NO: 5880 - protein, 7 aa, Artificial Sequence
  synthetic construct
IYASGST

SEQ ID NO: 5881 - protein, 8 aa, Artificial Sequence
  synthetic construct
IYPGDSDT

SEQ ID NO: 5882 - protein, 10 aa, Artificial Sequence
  synthetic construct
IKSKTDGGTT

SEQ ID NO: 5883 - protein, 8 aa, Artificial Sequence
  synthetic construct
ISKDGNSK

SEQ ID NO: 5884 - protein, 10 aa, Artificial Sequence
  synthetic construct
IRSKTKNYAT

SEQ ID NO: 5885 - protein, 7 aa, Artificial Sequence
  synthetic construct
IYTSGST

SEQ ID NO: 5886 - protein, 10 aa, Artificial Sequence
  synthetic construct
ISTKGYDETA

SEQ ID NO: 5887 - protein, 8 aa, Artificial Sequence
  synthetic construct
IPYDGSNK

SEQ ID NO: 5888 - protein, 8 aa, Artificial Sequence
  synthetic construct
ISTSTSTI

SEQ ID NO: 5889 - protein, 8 aa, Artificial Sequence
  synthetic construct
ISSSGSTI

SEQ ID NO: 5890 - protein, 8 aa, Artificial Sequence
  synthetic construct
ISSSSSTI

SEQ ID NO: 5891 - protein, 7 aa, Artificial Sequence
  synthetic construct
MYSGGAT

SEQ ID NO: 5892 - protein, 8 aa, Artificial Sequence
  synthetic construct
IYPGDSDT

SEQ ID NO: 5893 - protein, 10 aa, Artificial Sequence
  synthetic construct
IRSKPNSYAT

SEQ ID NO: 5894 - protein, 8 aa, Artificial Sequence
  synthetic construct
IWYDGSNE

SEQ ID NO: 5895 - protein, 8 aa, Artificial Sequence
  synthetic construct
IWYDGSNK

SEQ ID NO: 5896 - protein, 7 aa, Artificial Sequence
  synthetic construct
LNSDGSH

SEQ ID NO: 5897 - protein, 7 aa, Artificial Sequence
  synthetic construct
QYSDSDK

SEQ ID NO: 5898 - protein, 14 aa, Artificial Sequence
  synthetic construct
ARVTLGSYFYGMDV

SEQ ID NO: 5899 - protein, 15 aa, Artificial Sequence
  synthetic construct
ARDGGSGSYFDCFDY

SEQ ID NO: 5900 - protein, 18 aa, Artificial Sequence
  synthetic construct
AKDINFFGLGTGGGAMDV

SEQ ID NO: 5901 - protein, 11 aa, Artificial Sequence
  synthetic construct
AHRAIVGLFDY

SEQ ID NO: 5902 - protein, 14 aa, Artificial Sequence
  synthetic construct
ARGGDGGPQDAFDI

SEQ ID NO: 5903 - protein, 17 aa, Artificial Sequence
  synthetic construct
VKSFSAEYYYYYYGMDV

SEQ ID NO: 5904 - protein, 15 aa, Artificial Sequence
  synthetic construct
ARVVPGDSVYGAFDI

SEQ ID NO: 5905 - protein, 13 aa, Artificial Sequence
  synthetic construct
AKRTPFGEWAFDY

SEQ ID NO: 5906 - protein, 17 aa, Artificial Sequence
  synthetic construct
AKDPGTFRDHLWSGVDY

SEQ ID NO: 5907 - protein, 16 aa, Artificial Sequence
  synthetic construct
AKAAATLPYFRFAMDV

SEQ ID NO: 5908 - protein, 17 aa, Artificial Sequence
  synthetic construct
ARVGVFKGLAPFGGFDP

SEQ ID NO: 5909 - protein, 11 aa, Artificial Sequence
  synthetic construct
ARDSGGTPGPY

SEQ ID NO: 5910 - protein, 16 aa, Artificial Sequence
  synthetic construct
VRSFVGAVPAYPNFDF

SEQ ID NO: 5911 - protein, 11 aa, Artificial Sequence
  synthetic construct
VRGVVGATLDN

SEQ ID NO: 5912 - protein, 17 aa, Artificial Sequence
  synthetic construct
VKDSRVTGQSSGYIFDS

SEQ ID NO: 5913 - protein, 11 aa, Artificial Sequence
  synthetic construct
ARPRLGWYFDL

SEQ ID NO: 5914 - protein, 13 aa, Artificial Sequence
  synthetic construct
ARETAGQLIPFDY

SEQ ID NO: 5915 - protein, 17 aa, Artificial Sequence
  synthetic construct
ARDYMGVDFYYYYGMDV

SEQ ID NO: 5916 - protein, 14 aa, Artificial Sequence
  synthetic construct
ARDIAVAITNYFGS

SEQ ID NO: 5917 - protein, 11 aa, Artificial Sequence
  synthetic construct
AREHRSGYQRY

SEQ ID NO: 5918 - protein, 11 aa, Artificial Sequence
  synthetic construct
AHFSTVINFGH

SEQ ID NO: 5919 - protein, 11 aa, Artificial Sequence
  synthetic construct
ACRRIYQGFDP

SEQ ID NO: 5920 - protein, 10 aa, Artificial Sequence
  synthetic construct
ARDRATSFDY

SEQ ID NO: 5921 - protein, 9 aa, Artificial Sequence
  synthetic construct
ARGRGEMDV

SEQ ID NO: 5922 - protein, 14 aa, Artificial Sequence
  synthetic construct
ATTPSSSWYWYFDP

SEQ ID NO: 5923 - protein, 16 aa, Artificial Sequence
  synthetic construct
ARDLELIIAAGAPLDH

SEQ ID NO: 5924 - protein, 16 aa, Artificial Sequence
  synthetic construct
ARLVTSPEEGGPWFDP

SEQ ID NO: 5925 - protein, 12 aa, Artificial Sequence
  synthetic construct
ARDTEVGHHFDY

SEQ ID NO: 5926 - protein, 11 aa, Artificial Sequence
  synthetic construct
AKPWRSDGFDV

SEQ ID NO: 5927 - protein, 11 aa, Artificial Sequence
  synthetic construct
AVGMVTDGFEI

SEQ ID NO: 5928 - protein, 12 aa, Artificial Sequence
  synthetic construct
ARLDLRTVRFDP

SEQ ID NO: 5929 - protein, 14 aa, Artificial Sequence
  synthetic construct
ARHSSGPPRLAFDI

SEQ ID NO: 5930 - protein, 13 aa, Artificial Sequence
  synthetic construct
AKDFAMPTVTTDY

SEQ ID NO: 5931 - protein, 13 aa, Artificial Sequence
  synthetic construct
VHRPSLAYWYFDV

SEQ ID NO: 5932 - protein, 14 aa, Artificial Sequence
  synthetic construct
VREGDSRKYYSLDY

SEQ ID NO: 5933 - protein, 13 aa, Artificial Sequence
  synthetic construct
ARDPMWVSYAFDI

SEQ ID NO: 5934 - protein, 9 aa, Artificial Sequence
  synthetic construct
ASGYVSFDL

SEQ ID NO: 5935 - protein, 16 aa, Artificial Sequence
  synthetic construct
AREGAYESSGPDPFDI

SEQ ID NO: 5936 - protein, 15 aa, Artificial Sequence
  synthetic construct
ASLFLTYYGSGTYYR

SEQ ID NO: 5937 - protein, 11 aa, Artificial Sequence
  synthetic construct
AKSTLGGGFDF

SEQ ID NO: 5938 - protein, 18 aa, Artificial Sequence
  synthetic construct
ARVGSSSWYSSGRSPFDY

SEQ ID NO: 5939 - protein, 16 aa, Artificial Sequence
  synthetic construct
AKDQIVLEMATSPFDY

SEQ ID NO: 5940 - protein, 17 aa, Artificial Sequence
  synthetic construct
ARDLSCSSTSCHDAFDI

SEQ ID NO: 5941 - protein, 16 aa, Artificial Sequence
  synthetic construct
ARGPNFHESIRDGFDI

SEQ ID NO: 5942 - protein, 12 aa, Artificial Sequence
  synthetic construct
ARVNWNSDTFDS

SEQ ID NO: 5943 - protein, 20 aa, Artificial Sequence
  synthetic construct
ARDPGRDPYLDLDYHYGMDV

SEQ ID NO: 5944 - protein, 16 aa, Artificial Sequence
  synthetic construct
ARDKRSGMTSDRRIDY

SEQ ID NO: 5945 - protein, 12 aa, Artificial Sequence
  synthetic construct
SGGYYSSSHMDV

SEQ ID NO: 5946 - protein, 13 aa, Artificial Sequence
  synthetic construct
ARVNIAAAGTLDY

SEQ ID NO: 5947 - protein, 21 aa, Artificial Sequence
  synthetic construct
VKDMGPAGTASAYHYHNGMDV

SEQ ID NO: 5948 - protein, 12 aa, Artificial Sequence
  synthetic construct
ARLTTSTSALSY

SEQ ID NO: 5949 - protein, 16 aa, Artificial Sequence
  synthetic construct
ARENWNSAGTTEWFDP

SEQ ID NO: 5950 - protein, 10 aa, Artificial Sequence
  synthetic construct
ARDTLQKGDY

SEQ ID NO: 5951 - protein, 19 aa, Artificial Sequence
  synthetic construct
ARASRVLESKSWHGDAFDV

SEQ ID NO: 5952 - protein, 13 aa, Artificial Sequence
  synthetic construct
ARGLGGSGYYFDY

SEQ ID NO: 5953 - protein, 17 aa, Artificial Sequence
  synthetic construct
ARQAFCGANCWSGAYDI

SEQ ID NO: 5954 - protein, 19 aa, Artificial Sequence
  synthetic construct
VRRGATVFQGKIIKGYMDV

SEQ ID NO: 5955 - protein, 10 aa, Artificial Sequence
  synthetic construct
AKVKGGSNDY

SEQ ID NO: 5956 - protein, 13 aa, Artificial Sequence
  synthetic construct
ARHLYGDFYYLDY

SEQ ID NO: 5957 - protein, 13 aa, Artificial Sequence
  synthetic construct
ARDHRTGSYYPDY

SEQ ID NO: 5958 - protein, 15 aa, Artificial Sequence
  synthetic construct
ARGVRQQQVRKWFDP

SEQ ID NO: 5959 - protein, 12 aa, Artificial Sequence
  synthetic construct
AMDNSGSGGVDY

SEQ ID NO: 5960 - protein, 12 aa, Artificial Sequence
  synthetic construct
ARDSYHYYGMDV

SEQ ID NO: 5961 - protein, 16 aa, Artificial Sequence
  synthetic construct
ARETVYISTYYYGLDV

SEQ ID NO: 5962 - protein, 13 aa, Artificial Sequence
  synthetic construct
ATDGPLHTSGLDY

SEQ ID NO: 5963 - protein, 13 aa, Artificial Sequence
  synthetic construct
ACLGAEANDAFDI

SEQ ID NO: 5964 - protein, 7 aa, Artificial Sequence
  synthetic construct
AKVPGDY

SEQ ID NO: 5965 - protein, 15 aa, Artificial Sequence
  synthetic construct
ARAGLSTSWPSWFDP

SEQ ID NO: 5966 - protein, 14 aa, Artificial Sequence
  synthetic construct
ARNDISFKQSAIDV

SEQ ID NO: 5967 - protein, 17 aa, Artificial Sequence
  synthetic construct
AKTKTMGVGGEYFGLDV

SEQ ID NO: 5968 - protein, 16 aa, Artificial Sequence
  synthetic construct
ARHKALWFGEAGAFDI

SEQ ID NO: 5969 - protein, 18 aa, Artificial Sequence
  synthetic construct
AKDLLGFRDQRNYYGMDV

SEQ ID NO: 5970 - protein, 13 aa, Artificial Sequence
  synthetic construct
ARSFYDTLFYFEN

SEQ ID NO: 5971 - protein, 12 aa, Artificial Sequence
  synthetic construct
ARVYSTKWDFDY

SEQ ID NO: 5972 - protein, 11 aa, Artificial Sequence
  synthetic construct
AKGGPLRPFDI

SEQ ID NO: 5973 - protein, 15 aa, Artificial Sequence
  synthetic construct
ARLSRDGYTIEHFDY

SEQ ID NO: 5974 - protein, 19 aa, Artificial Sequence
  synthetic construct
ARRGVSGGSAWTYYNFFDP

SEQ ID NO: 5975 - protein, 14 aa, Artificial Sequence
  synthetic construct
ARELPVIGRRTFDI

SEQ ID NO: 5976 - protein, 22 aa, Artificial Sequence
  synthetic construct
ARDSEVEKSDGYMASTAEYFQL

SEQ ID NO: 5977 - protein, 15 aa, Artificial Sequence
  synthetic construct
VKAGVPWEVQRWFDP

SEQ ID NO: 5978 - protein, 12 aa, Artificial Sequence
  synthetic construct
ARDRQGLGRMDV

SEQ ID NO: 5979 - protein, 12 aa, Artificial Sequence
  synthetic construct
ARELGANYYFAY

SEQ ID NO: 5980 - protein, 15 aa, Artificial Sequence
  synthetic construct
AREVDIRGDSDAFDI

SEQ ID NO: 5981 - protein, 10 aa, Artificial Sequence
  synthetic construct
ATTRNSAFLN

SEQ ID NO: 5982 - protein, 14 aa, Artificial Sequence
  synthetic construct
AKSAFGGVPDGFDI

SEQ ID NO: 5983 - protein, 7 aa, Artificial Sequence
  synthetic construct
ARDGFDY

SEQ ID NO: 5984 - protein, 13 aa, Artificial Sequence
  synthetic construct
AKAGYSFTTAPDY

SEQ ID NO: 5985 - protein, 14 aa, Artificial Sequence
  synthetic construct
ARERGQVRSYGMDV

SEQ ID NO: 5986 - protein, 19 aa, Artificial Sequence
  synthetic construct
VKIGGDGTAYAWTFRHFDS

SEQ ID NO: 5987 - protein, 13 aa, Artificial Sequence
  synthetic construct
ARGLGGDWNYLAY

SEQ ID NO: 5988 - protein, 21 aa, Artificial Sequence
  synthetic construct
AKEGGWGNTVTTSYYYYGMDV

SEQ ID NO: 5989 - protein, 14 aa, Artificial Sequence
  synthetic construct
TRDGGYFATGEFDY

SEQ ID NO: 5990 - protein, 12 aa, Artificial Sequence
  synthetic construct
ARERFGQGALDY

SEQ ID NO: 5991 - protein, 15 aa, Artificial Sequence
  synthetic construct
ATIVAAYSYGFEFDP

SEQ ID NO: 5992 - protein, 21 aa, Artificial Sequence
  synthetic construct
AKEGGWGNTVTTSYYYYGMDV

SEQ ID NO: 5993 - protein, 15 aa, Artificial Sequence
  synthetic construct
ARQGFEALVIRGFDY

SEQ ID NO: 5994 - protein, 15 aa, Artificial Sequence
  synthetic construct
ARRSTSSPSFSTLDV

SEQ ID NO: 5995 - protein, 10 aa, Artificial Sequence
  synthetic construct
ARQMVTTRGY

SEQ ID NO: 5996 - protein, 16 aa, Artificial Sequence
  synthetic construct
ARVPSRYGRSRGAFDI

SEQ ID NO: 5997 - protein, 12 aa, Artificial Sequence
  synthetic construct
ARNLYRLGWFDP

SEQ ID NO: 5998 - protein, 13 aa, Artificial Sequence
  synthetic construct
AKSKGNYRDAMDV

SEQ ID NO: 5999 - protein, 14 aa, Artificial Sequence
  synthetic construct
ATSYTVTTFYGMDV

SEQ ID NO: 6000 - protein, 12 aa, Artificial Sequence
  synthetic construct
ARGAAFYYGMDV

SEQ ID NO: 6001 - protein, 15 aa, Artificial Sequence
  synthetic construct
ARDTYGDPRGDYFDY

SEQ ID NO: 6002 - protein, 17 aa, Artificial Sequence
  synthetic construct
ARLWGSGDWWPSLYFDS

SEQ ID NO: 6003 - protein, 12 aa, Artificial Sequence
  synthetic construct
ARIRRIAATSFD

SEQ ID NO: 6004 - protein, 16 aa, Artificial Sequence
  synthetic construct
AKIARRPPSFYDYMDV

SEQ ID NO: 6005 - protein, 16 aa, Artificial Sequence
  synthetic construct
ARSTSSSTSDFHYMDV

SEQ ID NO: 6006 - protein, 10 aa, Artificial Sequence
  synthetic construct
TRGWAFTSSD

SEQ ID NO: 6007 - protein, 8 aa, Artificial Sequence
  synthetic construct
AGGWALGY

SEQ ID NO: 6008 - protein, 10 aa, Artificial Sequence
  synthetic construct
ARHRIFGLDV

SEQ ID NO: 6009 - protein, 19 aa, Artificial Sequence
  synthetic construct
ARRGPTDTWSGEVGYYFDY

SEQ ID NO: 6010 - protein, 16 aa, Artificial Sequence
  synthetic construct
ARDGKTLGYGGNSVDY

SEQ ID NO: 6011 - protein, 15 aa, Artificial Sequence
  synthetic construct
ARTETKWEDRGLWDY

SEQ ID NO: 6012 - protein, 10 aa, Artificial Sequence
  synthetic construct
ARSFYGSGLQ

SEQ ID NO: 6013 - protein, 13 aa, Artificial Sequence
  synthetic construct
ARAMGGYTYYLDD

SEQ ID NO: 6014 - protein, 17 aa, Artificial Sequence
  synthetic construct
ARAGKDGYNFFYYGMDV

SEQ ID NO: 6015 - protein, 15 aa, Artificial Sequence
  synthetic construct
ARGIMTTAISYYFDY

SEQ ID NO: 6016 - protein, 18 aa, Artificial Sequence
  synthetic construct
AKGERDLTDYGDPEYFQH

SEQ ID NO: 6017 - protein, 18 aa, Artificial Sequence
  synthetic construct
AKDLRYCSARSSCFGIDF

SEQ ID NO: 6018 - protein, 9 aa, Artificial Sequence
  synthetic construct
ARRAYSFDY

SEQ ID NO: 6019 - protein, 18 aa, Artificial Sequence
  synthetic construct
AREGAPDDYGDSGTAFDI

SEQ ID NO: 6020 - protein, 12 aa, Artificial Sequence
  synthetic construct
TTDHPYGDYSDN

SEQ ID NO: 6021 - protein, 10 aa, Artificial Sequence
  synthetic construct
AKELLGGFDY

SEQ ID NO: 6022 - protein, 13 aa, Artificial Sequence
  synthetic construct
ARVFGSAAGAFDI

SEQ ID NO: 6023 - protein, 12 aa, Artificial Sequence
  synthetic construct
ARHDWRLYAFDY

SEQ ID NO: 6024 - protein, 9 aa, Artificial Sequence
  synthetic construct
AGGETSPDY

SEQ ID NO: 6025 - protein, 15 aa, Artificial Sequence
  synthetic construct
VSRGPLGGAAAGPDY

SEQ ID NO: 6026 - protein, 10 aa, Artificial Sequence
  synthetic construct
ARDVRGWFVP

SEQ ID NO: 6027 - protein, 19 aa, Artificial Sequence
  synthetic construct
VRDRNIVSVPGAIPYGMDV

SEQ ID NO: 6028 - protein, 9 aa, Artificial Sequence
  synthetic construct
ARGSDTLDY

SEQ ID NO: 6029 - protein, 12 aa, Artificial Sequence
  synthetic construct
ARVGLTFALFDP

SEQ ID NO: 6030 - protein, 17 aa, Artificial Sequence
  synthetic construct
ANSAGIQLWSSDNWFDP

SEQ ID NO: 6031 - protein, 10 aa, Artificial Sequence
  synthetic construct
AKEGIELMIL

SEQ ID NO: 6032 - protein, 14 aa, Artificial Sequence
  synthetic construct
ARGITLTRGVSFDY

SEQ ID NO: 6033 - protein, 9 aa, Artificial Sequence
  synthetic construct
ARDGGAFDI

SEQ ID NO: 6034 - protein, 16 aa, Artificial Sequence
  synthetic construct
ARDRLFTAINSGYFDY

SEQ ID NO: 6035 - protein, 11 aa, Artificial Sequence
  synthetic construct
AREGSYYGIGY

SEQ ID NO: 6036 - protein, 14 aa, Artificial Sequence
  synthetic construct
ARDTDSGWLDSFDY

SEQ ID NO: 6037 - protein, 21 aa, Artificial Sequence
  synthetic construct
ATDQGCDDGSCYVGHYYGMDV

SEQ ID NO: 6038 - protein, 10 aa, Artificial Sequence
  synthetic construct
GRIMTPSIDL

SEQ ID NO: 6039 - protein, 13 aa, Artificial Sequence
  synthetic construct
AREGRGGGDFFDY

SEQ ID NO: 6040 - protein, 15 aa, Artificial Sequence
  synthetic construct
AKDGDSLGDFSTFDI

SEQ ID NO: 6041 - protein, 12 aa, Artificial Sequence
  synthetic construct
ARDGYDFRAFDH

SEQ ID NO: 6042 - protein, 20 aa, Artificial Sequence
  synthetic construct
ARARGGGFCSNMDCPAMFDY

SEQ ID NO: 6043 - protein, 9 aa, Artificial Sequence
  synthetic construct
TTIHDYGDH

SEQ ID NO: 6044 - protein, 10 aa, Artificial Sequence
  synthetic construct
ARGLLRSLDV

SEQ ID NO: 6045 - protein, 14 aa, Artificial Sequence
  synthetic construct
ARVKLGASSRVFDV

SEQ ID NO: 6046 - protein, 13 aa, Artificial Sequence
  synthetic construct
ATTVTPKVTSFAS

SEQ ID NO: 6047 - protein, 15 aa, Artificial Sequence
  synthetic construct
AREQSPLYFGPSLDV

SEQ ID NO: 6048 - protein, 12 aa, Artificial Sequence
  synthetic construct
AREPYSSYAMDV

SEQ ID NO: 6049 - protein, 12 aa, Artificial Sequence
  synthetic construct
AKDGSEMLLCDY

SEQ ID NO: 6050 - protein, 11 aa, Artificial Sequence
  synthetic construct
ARDTRWRGLDS

SEQ ID NO: 6051 - protein, 13 aa, Artificial Sequence
  synthetic construct
AKDLLAVPGLLDD

SEQ ID NO: 6052 - protein, 14 aa, Artificial Sequence
  synthetic construct
ASRGGSSRRYGMGV

SEQ ID NO: 6053 - protein, 16 aa, Artificial Sequence
  synthetic construct
VKLKGIGAMWTYAMDV

SEQ ID NO: 6054 - protein, 18 aa, Artificial Sequence
  synthetic construct
ARDQGYGDYDYPRDWIEP

SEQ ID NO: 6055 - protein, 16 aa, Artificial Sequence
  synthetic construct
ASVRDLVSGTTYYYHY

SEQ ID NO: 6056 - protein, 10 aa, Artificial Sequence
  synthetic construct
ARYGDYSFDP

SEQ ID NO: 6057 - protein, 13 aa, Artificial Sequence
  synthetic construct
ARVVDTVLADFDY

SEQ ID NO: 6058 - protein, 14 aa, Artificial Sequence
  synthetic construct
ARSGGFGWSRDLDY

SEQ ID NO: 6059 - protein, 16 aa, Artificial Sequence
  synthetic construct
ARHGFWSGPIPDAFDI

SEQ ID NO: 6060 - protein, 12 aa, Artificial Sequence
  synthetic construct
AHEDYGSGNGNY

SEQ ID NO: 6061 - protein, 15 aa, Artificial Sequence
  synthetic construct
ARDRDSGYERNCLDP

SEQ ID NO: 6062 - protein, 22 aa, Artificial Sequence
  synthetic construct
ARGAPYGSRIYYDYDSYHGMDV

SEQ ID NO: 6063 - protein, 16 aa, Artificial Sequence
  synthetic construct
ARGKFDWFPRVSSFDY

SEQ ID NO: 6064 - protein, 13 aa, Artificial Sequence
  synthetic construct
AAAYYIDTSGFDY

SEQ ID NO: 6065 - protein, 18 aa, Artificial Sequence
  synthetic construct
AKGRTYSNNWLFHWYFDL

SEQ ID NO: 6066 - protein, 13 aa, Artificial Sequence
  synthetic construct
ARVFSTIFHGVDP

SEQ ID NO: 6067 - protein, 15 aa, Artificial Sequence
  synthetic construct
ARHLSSGEYHYGLDV

SEQ ID NO: 6068 - protein, 13 aa, Artificial Sequence
  synthetic construct
AKGKGIVGATFDY

SEQ ID NO: 6069 - protein, 18 aa, Artificial Sequence
  synthetic construct
ARDALDFDWLLSAGGFDY

SEQ ID NO: 6070 - protein, 11 aa, Artificial Sequence
  synthetic construct
ARLLVGGAFDI

SEQ ID NO: 6071 - protein, 18 aa, Artificial Sequence
  synthetic construct
TPGSCSGGSCYSGDAFDI

SEQ ID NO: 6072 - protein, 15 aa, Artificial Sequence
  synthetic construct
ARESLDSASYSTIAH

SEQ ID NO: 6073 - protein, 15 aa, Artificial Sequence
  synthetic construct
ARDRGGNSWLDVFDM

SEQ ID NO: 6074 - protein, 15 aa, Artificial Sequence
  synthetic construct
ARSPAAFGSESYFDS

SEQ ID NO: 6075 - protein, 17 aa, Artificial Sequence
  synthetic construct
AKDLLEDPYFGDLLFDY

SEQ ID NO: 6076 - protein, 12 aa, Artificial Sequence
  synthetic construct
VRTPAVGTDPDY

SEQ ID NO: 6077 - protein, 12 aa, Artificial Sequence
  synthetic construct
SSGGSTSMVGRY

SEQ ID NO: 6078 - protein, 14 aa, Artificial Sequence
  synthetic construct
ARMTPFKFGLCPDY

SEQ ID NO: 6079 - protein, 14 aa, Artificial Sequence
  synthetic construct
ARVVVVGTDYGMDV

SEQ ID NO: 6080 - protein, 14 aa, Artificial Sequence
  synthetic construct
ARDQGLERANWFDP

SEQ ID NO: 6081 - protein, 9 aa, Artificial Sequence
  synthetic construct
ARGVRHFDY

SEQ ID NO: 6082 - protein, 12 aa, Artificial Sequence
  synthetic construct
ARESPLTVVFDY

SEQ ID NO: 6083 - protein, 11 aa, Artificial Sequence
  synthetic construct
ARESSAAGYDY

SEQ ID NO: 6084 - protein, 16 aa, Artificial Sequence
  synthetic construct
ARKLMSGIVSRGWFDP

SEQ ID NO: 6085 - protein, 14 aa, Artificial Sequence
  synthetic construct
ARDRGDYVTHWFDP

SEQ ID NO: 6086 - protein, 13 aa, Artificial Sequence
  synthetic construct
ARHRVGDSPGLHY

SEQ ID NO: 6087 - protein, 12 aa, Artificial Sequence
  synthetic construct
ASPIAVAAPFAY

SEQ ID NO: 6088 - protein, 17 aa, Artificial Sequence
  synthetic construct
VKDYLAVGGTYYDYFDY

SEQ ID NO: 6089 - protein, 11 aa, Artificial Sequence
  synthetic construct
ARHDYRNYFDY

SEQ ID NO: 6090 - protein, 15 aa, Artificial Sequence
  synthetic construct
ATPPSRYGGNYYADY

SEQ ID NO: 6091 - protein, 11 aa, Artificial Sequence
  synthetic construct
ARQGPTVAIDF

SEQ ID NO: 6092 - protein, 9 aa, Artificial Sequence
  synthetic construct
ARRGREFDY

SEQ ID NO: 6093 - protein, 17 aa, Artificial Sequence
  synthetic construct
AIQEKRELQLRRELDNY

SEQ ID NO: 6094 - protein, 10 aa, Artificial Sequence
  synthetic construct
ARVFRYGMDV

SEQ ID NO: 6095 - protein, 10 aa, Artificial Sequence
  synthetic construct
AIKEGYGLSD

SEQ ID NO: 6096 - protein, 12 aa, Artificial Sequence
  synthetic construct
AKEDGYTQNFDY

SEQ ID NO: 6097 - protein, 14 aa, Artificial Sequence
  synthetic construct
ARVLDFYGSSVLDY

SEQ ID NO: 6098 - protein, 8 aa, Artificial Sequence
  synthetic construct
ARDRPGDY

SEQ ID NO: 6099 - protein, 11 aa, Artificial Sequence
  synthetic construct
ARDLGVGSTTY

SEQ ID NO: 6100 - protein, 14 aa, Artificial Sequence
  synthetic construct
VKDLEVSIGHNFDF

SEQ ID NO: 6101 - protein, 20 aa, Artificial Sequence
  synthetic construct
ARDRGVVVVAATPYYYGMDV

SEQ ID NO: 6102 - protein, 17 aa, Artificial Sequence
  synthetic construct
VHARDDYGDSAWSTGPV

SEQ ID NO: 6103 - protein, 17 aa, Artificial Sequence
  synthetic construct
GHRRLLRGVTTTVYFDP

SEQ ID NO: 6104 - protein, 17 aa, Artificial Sequence
  synthetic construct
ARGGELLGGFGYSGMDV

SEQ ID NO: 6105 - protein, 19 aa, Artificial Sequence
  synthetic construct
AHYYYDSSGYYQNAEYFQY

SEQ ID NO: 6106 - protein, 21 aa, Artificial Sequence
  synthetic construct
ARTQWGTDVEATNPYYYFMDV

SEQ ID NO: 6107 - protein, 12 aa, Artificial Sequence
  synthetic construct
ARDQSGADRFDS

SEQ ID NO: 6108 - protein, 13 aa, Artificial Sequence
  synthetic construct
ARSSKWTDWHFDY

SEQ ID NO: 6109 - protein, 14 aa, Artificial Sequence
  synthetic construct
ARDLDEINSSWLDP

SEQ ID NO: 6110 - protein, 17 aa, Artificial Sequence
  synthetic construct
AKRPTAGNSYGGYYFDH

SEQ ID NO: 6111 - protein, 19 aa, Artificial Sequence
  synthetic construct
ARRGEVGTMVRVFRKPFDY

SEQ ID NO: 6112 - protein, 18 aa, Artificial Sequence
  synthetic construct
ATTSTMPMPTRGRDWFDP

SEQ ID NO: 6113 - protein, 11 aa, Artificial Sequence
  synthetic construct
AGAHGDYGLDY

SEQ ID NO: 6114 - protein, 15 aa, Artificial Sequence
  synthetic construct
ARHQQKYSPISPLDY

SEQ ID NO: 6115 - protein, 13 aa, Artificial Sequence
  synthetic construct
AKDARLAYYGMDV

SEQ ID NO: 6116 - protein, 12 aa, Artificial Sequence
  synthetic construct
ARHSSGYSELAY

SEQ ID NO: 6117 - protein, 14 aa, Artificial Sequence
  synthetic construct
ARVHNWDFYYGMDV

SEQ ID NO: 6118 - protein, 15 aa, Artificial Sequence
  synthetic construct
TRERPPNCGSSCPET

SEQ ID NO: 6119 - protein, 12 aa, Artificial Sequence
  synthetic construct
ARVGTSHWYSDS

SEQ ID NO: 6120 - protein, 10 aa, Artificial Sequence
  synthetic construct
ARDEGRREGA

SEQ ID NO: 6121 - protein, 13 aa, Artificial Sequence
  synthetic construct
ARDIALGRGGMDV

SEQ ID NO: 6122 - protein, 12 aa, Artificial Sequence
  synthetic construct
ARHRTGQYYYNS

SEQ ID NO: 6123 - protein, 11 aa, Artificial Sequence
  synthetic construct
AASGYGDHVAY

SEQ ID NO: 6124 - protein, 16 aa, Artificial Sequence
  synthetic construct
ARGNGPKSGKYSDFDY

SEQ ID NO: 6125 - protein, 10 aa, Artificial Sequence
  synthetic construct
ARDKSWYFDY

SEQ ID NO: 6126 - protein, 15 aa, Artificial Sequence
  synthetic construct
ARSTASSGYYDAFDI

SEQ ID NO: 6127 - protein, 22 aa, Artificial Sequence
  synthetic construct
ARDRREYSSSSRPSYHYYYMDV

SEQ ID NO: 6128 - protein, 13 aa, Artificial Sequence
  synthetic construct
ASRYRSPSGAFDI

SEQ ID NO: 6129 - protein, 8 aa, Artificial Sequence
  synthetic construct
TRGAVADY

SEQ ID NO: 6130 - protein, 14 aa, Artificial Sequence
  synthetic construct
ATSHGGLVPGGENY

SEQ ID NO: 6131 - protein, 16 aa, Artificial Sequence
  synthetic construct
VREEFGVVRGPNPFDV

SEQ ID NO: 6132 - protein, 19 aa, Artificial Sequence
  synthetic construct
AKTRSYSSADTTRPNAPGY

SEQ ID NO: 6133 - protein, 15 aa, Artificial Sequence
  synthetic construct
AKDGQTGTTTPYFDY

SEQ ID NO: 6134 - protein, 10 aa, Artificial Sequence
  synthetic construct
ARAGAEGVDY

SEQ ID NO: 6135 - protein, 14 aa, Artificial Sequence
  synthetic construct
ARRSDKAVPGTFDQ

SEQ ID NO: 6136 - protein, 15 aa, Artificial Sequence
  synthetic construct
AHRGGKNPRYWYFDL

SEQ ID NO: 6137 - protein, 13 aa, Artificial Sequence
  synthetic construct
ARGEGGELWAFDY

SEQ ID NO: 6138 - protein, 14 aa, Artificial Sequence
  synthetic construct
AREGLRLARGWFHP

SEQ ID NO: 6139 - protein, 12 aa, Artificial Sequence
  synthetic construct
ARDFDDGYDIRY

SEQ ID NO: 6140 - protein, 13 aa, Artificial Sequence
  synthetic construct
VKSPVAANDAFDI

SEQ ID NO: 6141 - protein, 13 aa, Artificial Sequence
  synthetic construct
ARVSVAAPTCLDY

SEQ ID NO: 6142 - protein, 15 aa, Artificial Sequence
  synthetic construct
ARHSGHDQLPLDFDN

SEQ ID NO: 6143 - protein, 9 aa, Artificial Sequence
  synthetic construct
AGGGSQVDF

SEQ ID NO: 6144 - protein, 17 aa, Artificial Sequence
  synthetic construct
AHRFGRGVSYYYYGMDV

SEQ ID NO: 6145 - protein, 12 aa, Artificial Sequence
  synthetic construct
AKDSGSNDDMDV

SEQ ID NO: 6146 - protein, 13 aa, Artificial Sequence
  synthetic construct
ARRGFYYYYGMDV

SEQ ID NO: 6147 - protein, 10 aa, Artificial Sequence
  synthetic construct
ASLLGGDPDY

SEQ ID NO: 6148 - protein, 20 aa, Artificial Sequence
  synthetic construct
ARMQIVATTQTYYYYYGMDV

SEQ ID NO: 6149 - protein, 13 aa, Artificial Sequence
  synthetic construct
ARAGYDLFGWFDP

SEQ ID NO: 6150 - protein, 19 aa, Artificial Sequence
  synthetic construct
AKPNSPFTGSGSFHNYFDY

SEQ ID NO: 6151 - protein, 6 aa, Artificial Sequence
  synthetic construct
ASPVRP

SEQ ID NO: 6152 - protein, 21 aa, Artificial Sequence
  synthetic construct
ARGFCDLPACYPVPQYNWFDP

SEQ ID NO: 6153 - protein, 13 aa, Artificial Sequence
  synthetic construct
ARYSGSYPLGFDY

SEQ ID NO: 6154 - protein, 9 aa, Artificial Sequence
  synthetic construct
ARHEGAFDI

SEQ ID NO: 6155 - protein, 12 aa, Artificial Sequence
  synthetic construct
TTDLAVTTRFDY

SEQ ID NO: 6156 - protein, 11 aa, Artificial Sequence
  synthetic construct
ARSTRTDALDV

SEQ ID NO: 6157 - protein, 13 aa, Artificial Sequence
  synthetic construct
AKNDEMDFKGYDY

SEQ ID NO: 6158 - protein, 9 aa, Artificial Sequence
  synthetic construct
ARGELLFDH

SEQ ID NO: 6159 - protein, 10 aa, Artificial Sequence
  synthetic construct
ARESTVVLDF

SEQ ID NO: 6160 - protein, 12 aa, Artificial Sequence
  synthetic construct
AKRSTAVGDFDP

SEQ ID NO: 6161 - protein, 16 aa, Artificial Sequence
  synthetic construct
ARGPSNWNGGPEHMDV

SEQ ID NO: 6162 - protein, 6 aa, Artificial Sequence
  synthetic construct
ARDFDY

SEQ ID NO: 6163 - protein, 14 aa, Artificial Sequence
  synthetic construct
ARDPYGSGTVWFDP

SEQ ID NO: 6164 - protein, 20 aa, Artificial Sequence
  synthetic construct
AKTEYTFLSGSDYYQYGMDV

SEQ ID NO: 6165 - protein, 16 aa, Artificial Sequence
  synthetic construct
ARRGLLRGSNEGRFDY

SEQ ID NO: 6166 - protein, 15 aa, Artificial Sequence
  synthetic construct
TRRGSAWTDPYYTDV

SEQ ID NO: 6167 - protein, 11 aa, Artificial Sequence
  synthetic construct
ARDDVPRGYDY

SEQ ID NO: 6168 - protein, 13 aa, Artificial Sequence
  synthetic construct
AREYIVPFYGMDV

SEQ ID NO: 6169 - protein, 9 aa, Artificial Sequence
  synthetic construct
QQTNTFPLT

SEQ ID NO: 6170 - protein, 9 aa, Artificial Sequence
  synthetic construct
QQSYSTPPR

SEQ ID NO: 6171 - protein, 9 aa, Artificial Sequence
  synthetic construct
QQSNSFPGT

SEQ ID NO: 6172 - protein, 11 aa, Artificial Sequence
  synthetic construct
AAWEDSLSGPV

SEQ ID NO: 6173 - protein, 9 aa, Artificial Sequence
  synthetic construct
NSRDRSGYV

SEQ ID NO: 6174 - protein, 11 aa, Artificial Sequence
  synthetic construct
QVWDNGHSHWV

SEQ ID NO: 6175 - protein, 9 aa, Artificial Sequence
  synthetic construct
QQSYRMPCS

SEQ ID NO: 6176 - protein, 10 aa, Artificial Sequence
  synthetic construct
QQYGSSPPIT

SEQ ID NO: 6177 - protein, 9 aa, Artificial Sequence
  synthetic construct
QSYDTTNVI

SEQ ID NO: 6178 - protein, 9 aa, Artificial Sequence
  synthetic construct
QQYDSSPFT

SEQ ID NO: 6179 - protein, 10 aa, Artificial Sequence
  synthetic construct
GTWDDNLSAV

SEQ ID NO: 6180 - protein, 9 aa, Artificial Sequence
  synthetic construct
LQGTHWPPT

SEQ ID NO: 6181 - protein, 11 aa, Artificial Sequence
  synthetic construct
AAWDDNVSGPG

SEQ ID NO: 6182 - protein, 11 aa, Artificial Sequence
  synthetic construct
ATWDDSLNGPV

SEQ ID NO: 6183 - protein, 8 aa, Artificial Sequence
  synthetic construct
QQYNNWWT

SEQ ID NO: 6184 - protein, 9 aa, Artificial Sequence
  synthetic construct
QQYGSFRYT

SEQ ID NO: 6185 - protein, 10 aa, Artificial Sequence
  synthetic construct
QSADSSDTYV

SEQ ID NO: 6186 - protein, 9 aa, Artificial Sequence
  synthetic construct
QQRSNWPLT

SEQ ID NO: 6187 - protein, 10 aa, Artificial Sequence
  synthetic construct
QQGSNWLALT

SEQ ID NO: 6188 - protein, 9 aa, Artificial Sequence
  synthetic construct
QQYYINPRT

SEQ ID NO: 6189 - protein, 9 aa, Artificial Sequence
  synthetic construct
QQYYSTPYT

SEQ ID NO: 6190 - protein, 9 aa, Artificial Sequence
  synthetic construct
QQSFNTVLT

SEQ ID NO: 6191 - protein, 11 aa, Artificial Sequence
  synthetic construct
SSYTITSTLWV

SEQ ID NO: 6192 - protein, 11 aa, Artificial Sequence
  synthetic construct
AAWDDSLSGPV

SEQ ID NO: 6193 - protein, 9 aa, Artificial Sequence
  synthetic construct
QQTYSNPWT

SEQ ID NO: 6194 - protein, 9 aa, Artificial Sequence
  synthetic construct
QQTYSHPRT

SEQ ID NO: 6195 - protein, 11 aa, Artificial Sequence
  synthetic construct
QSYDSSLSGYV

SEQ ID NO: 6196 - protein, 11 aa, Artificial Sequence
  synthetic construct
QVWDSSSDHYV

SEQ ID NO: 6197 - protein, 9 aa, Artificial Sequence
  synthetic construct
QQTSSFPRT

SEQ ID NO: 6198 - protein, 10 aa, Artificial Sequence
  synthetic construct
QSVDITSTWV

SEQ ID NO: 6199 - protein, 11 aa, Artificial Sequence
  synthetic construct
SSYISSLTYVL

SEQ ID NO: 6200 - protein, 11 aa, Artificial Sequence
  synthetic construct
GTWDSSLSVGV

SEQ ID NO: 6201 - protein, 9 aa, Artificial Sequence
  synthetic construct
MQGTHWPIT

SEQ ID NO: 6202 - protein, 9 aa, Artificial Sequence
  synthetic construct
QQYDSSSWT

SEQ ID NO: 6203 - protein, 11 aa, Artificial Sequence
  synthetic construct
QSYDSSLRGVV

SEQ ID NO: 6204 - protein, 9 aa, Artificial Sequence
  synthetic construct
QQSYSTPRT

SEQ ID NO: 6205 - protein, 9 aa, Artificial Sequence
  synthetic construct
QQYYSTPWT

SEQ ID NO: 6206 - protein, 13 aa, Artificial Sequence
  synthetic construct
QSYDSGLSGSKVV

SEQ ID NO: 6207 - protein, 9 aa, Artificial Sequence
  synthetic construct
QSYDLSTWV

SEQ ID NO: 6208 - protein, 9 aa, Artificial Sequence
  synthetic construct
HQSYSTSLT

SEQ ID NO: 6209 - protein, 11 aa, Artificial Sequence
  synthetic construct
QVWDSSSDHWV

SEQ ID NO: 6210 - protein, 10 aa, Artificial Sequence
  synthetic construct
SSYTSSSTQV

SEQ ID NO: 6211 - protein, 9 aa, Artificial Sequence
  synthetic construct
QQSYSTPKT

SEQ ID NO: 6212 - protein, 10 aa, Artificial Sequence
  synthetic construct
QQFNTYPLYT

SEQ ID NO: 6213 - protein, 11 aa, Artificial Sequence
  synthetic construct
DSRDSSGNLVV

SEQ ID NO: 6214 - protein, 9 aa, Artificial Sequence
  synthetic construct
QQTNSFPRT

SEQ ID NO: 6215 - protein, 10 aa, Artificial Sequence
  synthetic construct
QQSYSVPPWT

SEQ ID NO: 6216 - protein, 10 aa, Artificial Sequence
  synthetic construct
QQYGSSPRYT

SEQ ID NO: 6217 - protein, 8 aa, Artificial Sequence
  synthetic construct
QQYGSAWT

SEQ ID NO: 6218 - protein, 10 aa, Artificial Sequence
  synthetic construct
QQRANWPPIT

SEQ ID NO: 6219 - protein, 9 aa, Artificial Sequence
  synthetic construct
QQYNSYPWT

SEQ ID NO: 6220 - protein, 12 aa, Artificial Sequence
  synthetic construct
QVWDSSSDHYVV

SEQ ID NO: 6221 - protein, 10 aa, Artificial Sequence
  synthetic construct
QQRSNWPPLT

SEQ ID NO: 6222 - protein, 9 aa, Artificial Sequence
  synthetic construct
MQALQTPYT

SEQ ID NO: 6223 - protein, 8 aa, Artificial Sequence
  synthetic construct
QQYNSYST

SEQ ID NO: 6224 - protein, 10 aa, Artificial Sequence
  synthetic construct
LLYMGSGISV

SEQ ID NO: 6225 - protein, 10 aa, Artificial Sequence
  synthetic construct
QHYGASPPWT

SEQ ID NO: 6226 - protein, 12 aa, Artificial Sequence
  synthetic construct
QVWDSNNDHREV

SEQ ID NO: 6227 - protein, 9 aa, Artificial Sequence
  synthetic construct
QQYDSYPLS

SEQ ID NO: 6228 - protein, 9 aa, Artificial Sequence
  synthetic construct
LQHDNFPYT

SEQ ID NO: 6229 - protein, 9 aa, Artificial Sequence
  synthetic construct
QQYGSSPLT

SEQ ID NO: 6230 - protein, 11 aa, Artificial Sequence
  synthetic construct
YSTDSSGNHGV

SEQ ID NO: 6231 - protein, 9 aa, Artificial Sequence
  synthetic construct
MQALQTPNT

SEQ ID NO: 6232 - protein, 11 aa, Artificial Sequence
  synthetic construct
NSYSSSSTLYV

SEQ ID NO: 6233 - protein, 10 aa, Artificial Sequence
  synthetic construct
QQHSNWPELT

SEQ ID NO: 6234 - protein, 10 aa, Artificial Sequence
  synthetic construct
SSYRSSGVYV

SEQ ID NO: 6235 - protein, 9 aa, Artificial Sequence
  synthetic construct
MQSIHLPYT

SEQ ID NO: 6236 - protein, 10 aa, Artificial Sequence
  synthetic construct
HQYGGSPPNT

SEQ ID NO: 6237 - protein, 10 aa, Artificial Sequence
  synthetic construct
QQLNSYPPLT

SEQ ID NO: 6238 - protein, 11 aa, Artificial Sequence
  synthetic construct
ATWDSSLTAGV

SEQ ID NO: 6239 - protein, 9 aa, Artificial Sequence
  synthetic construct
QQRSAWPIT

SEQ ID NO: 6240 - protein, 10 aa, Artificial Sequence
  synthetic construct
QQYGSSRKLT

SEQ ID NO: 6241 - protein, 9 aa, Artificial Sequence
  synthetic construct
QHYDSYPWT

SEQ ID NO: 6242 - protein, 11 aa, Artificial Sequence
  synthetic construct
CSRDSSGNPWV

SEQ ID NO: 6243 - protein, 9 aa, Artificial Sequence
  synthetic construct
QQSYSTSLT

SEQ ID NO: 6244 - protein, 11 aa, Artificial Sequence
  synthetic construct
QQYDSSPPMYT

SEQ ID NO: 6245 - protein, 12 aa, Artificial Sequence
  synthetic construct
GTWDSSLSPGGV

SEQ ID NO: 6246 - protein, 8 aa, Artificial Sequence
  synthetic construct
QQSYNART

SEQ ID NO: 6247 - protein, 10 aa, Artificial Sequence
  synthetic construct
QQYYDTAPLT

SEQ ID NO: 6248 - protein, 9 aa, Artificial Sequence
  synthetic construct
QQYSKWPIT

SEQ ID NO: 6249 - protein, 9 aa, Artificial Sequence
  synthetic construct
QQTYTTPRT

SEQ ID NO: 6250 - protein, 11 aa, Artificial Sequence
  synthetic construct
QSYDSRLSGVV

SEQ ID NO: 6251 - protein, 9 aa, Artificial Sequence
  synthetic construct
QQYTTRPLT

SEQ ID NO: 6252 - protein, 9 aa, Artificial Sequence
  synthetic construct
QQRSKWPLT

SEQ ID NO: 6253 - protein, 12 aa, Artificial Sequence
  synthetic construct
ATWDDSLGGRVV

SEQ ID NO: 6254 - protein, 9 aa, Artificial Sequence
  synthetic construct
MQRIEFPFT

SEQ ID NO: 6255 - protein, 9 aa, Artificial Sequence
  synthetic construct
QAWDSSTAV

SEQ ID NO: 6256 - protein, 9 aa, Artificial Sequence
  synthetic construct
QSWDSSSVL

SEQ ID NO: 6257 - protein, 9 aa, Artificial Sequence
  synthetic construct
QQYYGRLFT

SEQ ID NO: 6258 - protein, 11 aa, Artificial Sequence
  synthetic construct
QQRSNWPPRLP

SEQ ID NO: 6259 - protein, 10 aa, Artificial Sequence
  synthetic construct
QQRSNWPPYT

SEQ ID NO: 6260 - protein, 9 aa, Artificial Sequence
  synthetic construct
MQALQTPYT

SEQ ID NO: 6261 - protein, 9 aa, Artificial Sequence
  synthetic construct
QHYDSYIGT

SEQ ID NO: 6262 - protein, 11 aa, Artificial Sequence
  synthetic construct
GTWDSSLGGGV

SEQ ID NO: 6263 - protein, 10 aa, Artificial Sequence
  synthetic construct
QQRSNWPPYT

SEQ ID NO: 6264 - protein, 9 aa, Artificial Sequence
  synthetic construct
MEAEQTPGT

SEQ ID NO: 6265 - protein, 10 aa, Artificial Sequence
  synthetic construct
SSYTSSTTVL

SEQ ID NO: 6266 - protein, 10 aa, Artificial Sequence
  synthetic construct
MQGTHWPPIT

SEQ ID NO: 6267 - protein, 9 aa, Artificial Sequence
  synthetic construct
HQTYSTRLT

SEQ ID NO: 6268 - protein, 9 aa, Artificial Sequence
  synthetic construct
QQYDNLPLT

SEQ ID NO: 6269 - protein, 11 aa, Artificial Sequence
  synthetic construct
QVWDSSSDPWV

SEQ ID NO: 6270 - protein, 10 aa, Artificial Sequence
  synthetic construct
QQLNSYPPVT

SEQ ID NO: 6271 - protein, 9 aa, Artificial Sequence
  synthetic construct
QQSYSTPYT

SEQ ID NO: 6272 - protein, 10 aa, Artificial Sequence
  synthetic construct
QQYSSSSPRT

SEQ ID NO: 6273 - protein, 9 aa, Artificial Sequence
  synthetic construct
MQSLQLPIT

SEQ ID NO: 6274 - protein, 10 aa, Artificial Sequence
  synthetic construct
QQSYSTRLLT

SEQ ID NO: 6275 - protein, 11 aa, Artificial Sequence
  synthetic construct
QSFDSSLRGYV

SEQ ID NO: 6276 - protein, 11 aa, Artificial Sequence
  synthetic construct
QHRITWPPLIT

SEQ ID NO: 6277 - protein, 9 aa, Artificial Sequence
  synthetic construct
QQYAYVPIT

SEQ ID NO: 6278 - protein, 9 aa, Artificial Sequence
  synthetic construct
QQYYSIPLT

SEQ ID NO: 6279 - protein, 9 aa, Artificial Sequence
  synthetic construct
QQYGSSPLW

SEQ ID NO: 6280 - protein, 10 aa, Artificial Sequence
  synthetic construct
SSYTSSSTQV

SEQ ID NO: 6281 - protein, 11 aa, Artificial Sequence
  synthetic construct
YSTDSSGNHRV

SEQ ID NO: 6282 - protein, 10 aa, Artificial Sequence
  synthetic construct
QQYNNWPQYT

SEQ ID NO: 6283 - protein, 11 aa, Artificial Sequence
  synthetic construct
QHFRSSPPTYT

SEQ ID NO: 6284 - protein, 10 aa, Artificial Sequence
  synthetic construct
SSYSRTTTLV

SEQ ID NO: 6285 - protein, 12 aa, Artificial Sequence
  synthetic construct
QSYDSGLSAPWV

SEQ ID NO: 6286 - protein, 9 aa, Artificial Sequence
  synthetic construct
QQYGNSPPT

SEQ ID NO: 6287 - protein, 11 aa, Artificial Sequence
  synthetic construct
ATWDDDLSGPV

SEQ ID NO: 6288 - protein, 9 aa, Artificial Sequence
  synthetic construct
LQHDTFPLT

SEQ ID NO: 6289 - protein, 9 aa, Artificial Sequence
  synthetic construct
QQYNSYSWT

SEQ ID NO: 6290 - protein, 9 aa, Artificial Sequence
  synthetic construct
QHLTSFPYT

SEQ ID NO: 6291 - protein, 11 aa, Artificial Sequence
  synthetic construct
GSRDSSGNPSV

SEQ ID NO: 6292 - protein, 9 aa, Artificial Sequence
  synthetic construct
QQRSNWLYT

SEQ ID NO: 6293 - protein, 12 aa, Artificial Sequence
  synthetic construct
QVWDSSSDHQEV

SEQ ID NO: 6294 - protein, 10 aa, Artificial Sequence
  synthetic construct
CSYAPSNTYV

SEQ ID NO: 6295 - protein, 9 aa, Artificial Sequence
  synthetic construct
QQRSNWPLT

SEQ ID NO: 6296 - protein, 12 aa, Artificial Sequence
  synthetic construct
NSRDSSAHDHLL

SEQ ID NO: 6297 - protein, 10 aa, Artificial Sequence
  synthetic construct
QHFGDSPLYI

SEQ ID NO: 6298 - protein, 9 aa, Artificial Sequence
  synthetic construct
QVWDSSTAV

SEQ ID NO: 6299 - protein, 11 aa, Artificial Sequence
  synthetic construct
QVWDSSSDHVV

SEQ ID NO: 6300 - protein, 11 aa, Artificial Sequence
  synthetic construct
QSADSSGFYVV

SEQ ID NO: 6301 - protein, 9 aa, Artificial Sequence
  synthetic construct
QSADSSSPV

SEQ ID NO: 6302 - protein, 10 aa, Artificial Sequence
  synthetic construct
YSTDSRATGV

SEQ ID NO: 6303 - protein, 9 aa, Artificial Sequence
  synthetic construct
QQSYSTPQT

SEQ ID NO: 6304 - protein, 9 aa, Artificial Sequence
  synthetic construct
QQYENLPLT

SEQ ID NO: 6305 - protein, 9 aa, Artificial Sequence
  synthetic construct
QQFDNLPLT

SEQ ID NO: 6306 - protein, 10 aa, Artificial Sequence
  synthetic construct
SSYAGSYTWV

SEQ ID NO: 6307 - protein, 9 aa, Artificial Sequence
  synthetic construct
QAWDSSTVV

SEQ ID NO: 6308 - protein, 11 aa, Artificial Sequence
  synthetic construct
GTWDSSLGAYV

SEQ ID NO: 6309 - protein, 8 aa, Artificial Sequence
  synthetic construct
QQYGSSLT

SEQ ID NO: 6310 - protein, 9 aa, Artificial Sequence
  synthetic construct
QQYGSSPLT

SEQ ID NO: 6311 - protein, 10 aa, Artificial Sequence
  synthetic construct
SSYTSSRSLV

SEQ ID NO: 6312 - protein, 9 aa, Artificial Sequence
  synthetic construct
QQTYSTPWT

SEQ ID NO: 6313 - protein, 8 aa, Artificial Sequence
  synthetic construct
QQYNNWLT

SEQ ID NO: 6314 - protein, 9 aa, Artificial Sequence
  synthetic construct
YSTPDNNGV

SEQ ID NO: 6315 - protein, 10 aa, Artificial Sequence
  synthetic construct
SSYTTSNSVV

SEQ ID NO: 6316 - protein, 9 aa, Artificial Sequence
  synthetic construct
QQYDNSPLT

SEQ ID NO: 6317 - protein, 9 aa, Artificial Sequence
  synthetic construct
QQYWGTPYT

SEQ ID NO: 6318 - protein, 10 aa, Artificial Sequence
  synthetic construct
QSYDSGLGVV

SEQ ID NO: 6319 - protein, 10 aa, Artificial Sequence
  synthetic construct
SSYAGINNLV

SEQ ID NO: 6320 - protein, 9 aa, Artificial Sequence
  synthetic construct
QQYNSYSQT

SEQ ID NO: 6321 - protein, 9 aa, Artificial Sequence
  synthetic construct
QQYTDWPYT

SEQ ID NO: 6322 - protein, 8 aa, Artificial Sequence
  synthetic construct
QTWGTVGV

SEQ ID NO: 6323 - protein, 9 aa, Artificial Sequence
  synthetic construct
QQYGSSPWT

SEQ ID NO: 6324 - protein, 11 aa, Artificial Sequence
  synthetic construct
QSYDSSLSGYV

SEQ ID NO: 6325 - protein, 11 aa, Artificial Sequence
  synthetic construct
QCFDTSLTAKV

SEQ ID NO: 6326 - protein, 9 aa, Artificial Sequence
  synthetic construct
MQALQVPRT

SEQ ID NO: 6327 - protein, 9 aa, Artificial Sequence
  synthetic construct
QQLNSYPLT

SEQ ID NO: 6328 - protein, 11 aa, Artificial Sequence
  synthetic construct
AAWDDSLSGPV

SEQ ID NO: 6329 - protein, 9 aa, Artificial Sequence
  synthetic construct
MQALQTPWT

SEQ ID NO: 6330 - protein, 12 aa, Artificial Sequence
  synthetic construct
NSRDSSDDHLEV

SEQ ID NO: 6331 - protein, 9 aa, Artificial Sequence
  synthetic construct
QQYNSYPRT

SEQ ID NO: 6332 - protein, 9 aa, Artificial Sequence
  synthetic construct
QQYFTTPRT

SEQ ID NO: 6333 - protein, 12 aa, Artificial Sequence
  synthetic construct
AAWDDGLGGLYV

SEQ ID NO: 6334 - protein, 8 aa, Artificial Sequence
  synthetic construct
QQYNRGST

SEQ ID NO: 6335 - protein, 11 aa, Artificial Sequence
  synthetic construct
QVWDRNSHRVI

SEQ ID NO: 6336 - protein, 11 aa, Artificial Sequence
  synthetic construct
QSYDNSLSAWV

SEQ ID NO: 6337 - protein, 11 aa, Artificial Sequence
  synthetic construct
NSRDSSGNHWV

SEQ ID NO: 6338 - protein, 11 aa, Artificial Sequence
  synthetic construct
SSYIRSSTPVV

SEQ ID NO: 6339 - protein, 9 aa, Artificial Sequence
  synthetic construct
QQYYDTPYT

SEQ ID NO: 6340 - protein, 10 aa, Artificial Sequence
  synthetic construct
SSYTSSSTLV

SEQ ID NO: 6341 - protein, 8 aa, Artificial Sequence
  synthetic construct
QQYDNLWT

SEQ ID NO: 6342 - protein, 12 aa, Artificial Sequence
  synthetic construct
QVWDSSSDHLYV

SEQ ID NO: 6343 - protein, 9 aa, Artificial Sequence
  synthetic construct
HQYGSSPRT

SEQ ID NO: 6344 - protein, 12 aa, Artificial Sequence
  synthetic construct
GTWDSSLTGGFV

SEQ ID NO: 6345 - protein, 11 aa, Artificial Sequence
  synthetic construct
QVWDTSNDVGV

SEQ ID NO: 6346 - protein, 9 aa, Artificial Sequence
  synthetic construct
QQYGSSPPT

SEQ ID NO: 6347 - protein, 10 aa, Artificial Sequence
  synthetic construct
CSYAGSSNWV

SEQ ID NO: 6348 - protein, 8 aa, Artificial Sequence
  synthetic construct
MQGTHWSA

SEQ ID NO: 6349 - protein, 11 aa, Artificial Sequence
  synthetic construct
AAWDDSLSGQV

SEQ ID NO: 6350 - protein, 10 aa, Artificial Sequence
  synthetic construct
NSRDSSGNHV

SEQ ID NO: 6351 - protein, 8 aa, Artificial Sequence
  synthetic construct
QQSYSTPT

SEQ ID NO: 6352 - protein, 11 aa, Artificial Sequence
  synthetic construct
QVWESGGDHPV

SEQ ID NO: 6353 - protein, 9 aa, Artificial Sequence
  synthetic construct
LQHNNYPLT

SEQ ID NO: 6354 - protein, 9 aa, Artificial Sequence
  synthetic construct
QQYNSYPYT

SEQ ID NO: 6355 - protein, 9 aa, Artificial Sequence
  synthetic construct
MQALQIPRT

SEQ ID NO: 6356 - protein, 9 aa, Artificial Sequence
  synthetic construct
QAWDSNVHV

SEQ ID NO: 6357 - protein, 11 aa, Artificial Sequence
  synthetic construct
YSTDSSGNVWV

SEQ ID NO: 6358 - protein, 11 aa, Artificial Sequence
  synthetic construct
NSRDSSGNLYV

SEQ ID NO: 6359 - protein, 9 aa, Artificial Sequence
  synthetic construct
QQYYSSPLT

SEQ ID NO: 6360 - protein, 10 aa, Artificial Sequence
  synthetic construct
MQALQTPPYT

SEQ ID NO: 6361 - protein, 10 aa, Artificial Sequence
  synthetic construct
SSYTSSSTWV

SEQ ID NO: 6362 - protein, 9 aa, Artificial Sequence
  synthetic construct
QQSYSTPYT

SEQ ID NO: 6363 - protein, 11 aa, Artificial Sequence
  synthetic construct
CSYAGSSTPWV

SEQ ID NO: 6364 - protein, 11 aa, Artificial Sequence
  synthetic construct
YSPDSSGNVWV

SEQ ID NO: 6365 - protein, 5 aa, Artificial Sequence
  synthetic construct
QSRGT

SEQ ID NO: 6366 - protein, 9 aa, Artificial Sequence
  synthetic construct
QQYGSSHYT

SEQ ID NO: 6367 - protein, 12 aa, Artificial Sequence
  synthetic construct
QVWDSSSDHPWV

SEQ ID NO: 6368 - protein, 11 aa, Artificial Sequence
  synthetic construct
CSYRSSTAPVV

SEQ ID NO: 6369 - protein, 9 aa, Artificial Sequence
  synthetic construct
QQYFSTPWT

SEQ ID NO: 6370 - protein, 11 aa, Artificial Sequence
  synthetic construct
QVWDGYSDPLV

SEQ ID NO: 6371 - protein, 9 aa, Artificial Sequence
  synthetic construct
QQSYYTPPT

SEQ ID NO: 6372 - protein, 12 aa, Artificial Sequence
  synthetic construct
AAWDDSLNGLWV

SEQ ID NO: 6373 - protein, 10 aa, Artificial Sequence
  synthetic construct
QSSDSNNHVV

SEQ ID NO: 6374 - protein, 11 aa, Artificial Sequence
  synthetic construct
QSYDSSLSGVL

SEQ ID NO: 6375 - protein, 9 aa, Artificial Sequence
  synthetic construct
QQSYSTPFT

SEQ ID NO: 6376 - protein, 9 aa, Artificial Sequence
  synthetic construct
QQYDSLPLT

SEQ ID NO: 6377 - protein, 10 aa, Artificial Sequence
  synthetic construct
QYYGGSPGFT

SEQ ID NO: 6378 - protein, 10 aa, Artificial Sequence
  synthetic construct
CSYAGSSTYV

SEQ ID NO: 6379 - protein, 10 aa, Artificial Sequence
  synthetic construct
QEYVKSPGFA

SEQ ID NO: 6380 - protein, 9 aa, Artificial Sequence
  synthetic construct
QQYGTSPQT

SEQ ID NO: 6381 - protein, 10 aa, Artificial Sequence
  synthetic construct
MLYMGSGISL

SEQ ID NO: 6382 - protein, 12 aa, Artificial Sequence
  synthetic construct
QSNDISLSGSVV

SEQ ID NO: 6383 - protein, 11 aa, Artificial Sequence
  synthetic construct
QSYDNSLSGGV

SEQ ID NO: 6384 - protein, 9 aa, Artificial Sequence
  synthetic construct
QQFDISPFT

SEQ ID NO: 6385 - protein, 10 aa, Artificial Sequence
  synthetic construct
SSYTSSSSLV

SEQ ID NO: 6386 - protein, 10 aa, Artificial Sequence
  synthetic construct
CSFTGTSTFV

SEQ ID NO: 6387 - protein, 9 aa, Artificial Sequence
  synthetic construct
QQYYSTPYT

SEQ ID NO: 6388 - protein, 11 aa, Artificial Sequence
  synthetic construct
ATWDDSLNGGV

SEQ ID NO: 6389 - protein, 9 aa, Artificial Sequence
  synthetic construct
WLISGGAPV

SEQ ID NO: 6390 - protein, 11 aa, Artificial Sequence
  synthetic construct
QSFDSSLSRSV

SEQ ID NO: 6391 - protein, 9 aa, Artificial Sequence
  synthetic construct
QQRNNWPIT

SEQ ID NO: 6392 - protein, 9 aa, Artificial Sequence
  synthetic construct
LQDYNYPPT

SEQ ID NO: 6393 - protein, 11 aa, Artificial Sequence
  synthetic construct
NSRDSSGHHWV

SEQ ID NO: 6394 - protein, 9 aa, Artificial Sequence
  synthetic construct
QQYYSTPYT

SEQ ID NO: 6395 - protein, 10 aa, Artificial Sequence
  synthetic construct
MQGAHWPPIT

SEQ ID NO: 6396 - protein, 10 aa, Artificial Sequence
  synthetic construct
YSTDTIGNWV

SEQ ID NO: 6397 - protein, 11 aa, Artificial Sequence
  synthetic construct
QVWDSSSDHWI

SEQ ID NO: 6398 - protein, 9 aa, Artificial Sequence
  synthetic construct
QQSYSPPLT

SEQ ID NO: 6399 - protein, 10 aa, Artificial Sequence
  synthetic construct
QHYSDWRALT

SEQ ID NO: 6400 - protein, 9 aa, Artificial Sequence
  synthetic construct
QQYYGPLWT

SEQ ID NO: 6401 - protein, 11 aa, Artificial Sequence
  synthetic construct
QSADSSLTYWL

SEQ ID NO: 6402 - protein, 8 aa, Artificial Sequence
  synthetic construct
QQYSDYST

SEQ ID NO: 6403 - protein, 9 aa, Artificial Sequence
  synthetic construct
HQYYTTPFT

SEQ ID NO: 6404 - protein, 9 aa, Artificial Sequence
  synthetic construct
QAWDSSTAE

SEQ ID NO: 6405 - protein, 11 aa, Artificial Sequence
  synthetic construct
VTWDDDLHGWV

SEQ ID NO: 6406 - protein, 13 aa, Artificial Sequence
  synthetic construct
ATWDSSLRAGPVV

SEQ ID NO: 6407 - protein, 9 aa, Artificial Sequence
  synthetic construct
QQYNAYPVT

SEQ ID NO: 6408 - protein, 9 aa, Artificial Sequence
  synthetic construct
QQYYSTPWT

SEQ ID NO: 6409 - protein, 9 aa, Artificial Sequence
  synthetic construct
QQYYSPPLT

SEQ ID NO: 6410 - protein, 10 aa, Artificial Sequence
  synthetic construct
CSYTSSLTYV

SEQ ID NO: 6411 - protein, 9 aa, Artificial Sequence
  synthetic construct
MQGTHWPYT

SEQ ID NO: 6412 - protein, 9 aa, Artificial Sequence
  synthetic construct
QAWDSSTYV

SEQ ID NO: 6413 - protein, 10 aa, Artificial Sequence
  synthetic construct
QQYGGSPLFT

SEQ ID NO: 6414 - protein, 9 aa, Artificial Sequence
  synthetic construct
QTWDSSTVI

SEQ ID NO: 6415 - protein, 9 aa, Artificial Sequence
  synthetic construct
MQALQTPYT

SEQ ID NO: 6416 - protein, 11 aa, Artificial Sequence
  synthetic construct
GTWDSSLSAGV

SEQ ID NO: 6417 - protein, 8 aa, Artificial Sequence
  synthetic construct
QQYNSYWT

SEQ ID NO: 6418 - protein, 9 aa, Artificial Sequence
  synthetic construct
QQYNSYPWT

SEQ ID NO: 6419 - protein, 12 aa, Artificial Sequence
  synthetic construct
QSYDSSLSGSGV

SEQ ID NO: 6420 - protein, 10 aa, Artificial Sequence
  synthetic construct
QSADSSGTYV

SEQ ID NO: 6421 - protein, 9 aa, Artificial Sequence
  synthetic construct
QQAHGFPIT

SEQ ID NO: 6422 - protein, 8 aa, Artificial Sequence
  synthetic construct
QQYNSWPA

SEQ ID NO: 6423 - protein, 9 aa, Artificial Sequence
  synthetic construct
QQSYNTPYT

SEQ ID NO: 6424 - protein, 9 aa, Artificial Sequence
  synthetic construct
QQSYNTPLT

SEQ ID NO: 6425 - protein, 10 aa, Artificial Sequence
  synthetic construct
QQYGSSPPNS

SEQ ID NO: 6426 - protein, 11 aa, Artificial Sequence
  synthetic construct
QVWDSSSDHPV

SEQ ID NO: 6427 - protein, 10 aa, Artificial Sequence
  synthetic construct
QSYDSNTHWV

SEQ ID NO: 6428 - protein, 9 aa, Artificial Sequence
  synthetic construct
MQALETPRT

SEQ ID NO: 6429 - protein, 8 aa, Artificial Sequence
  synthetic construct
QQYNSYST

SEQ ID NO: 6430 - protein, 9 aa, Artificial Sequence
  synthetic construct
MQALQPPYT

SEQ ID NO: 6431 - protein, 10 aa, Artificial Sequence
  synthetic construct
QQSYSTPPWT

SEQ ID NO: 6432 - protein, 9 aa, Artificial Sequence
  synthetic construct
QQYYLVPVT

SEQ ID NO: 6433 - protein, 12 aa, Artificial Sequence
  synthetic construct
AAWDDSLSGPYV

SEQ ID NO: 6434 - protein, 11 aa, Artificial Sequence
  synthetic construct
SSYAGSNNFYV

SEQ ID NO: 6435 - protein, 12 aa, Artificial Sequence
  synthetic construct
QSYDSSLSGSMI

SEQ ID NO: 6436 - protein, 8 aa, Artificial Sequence
  synthetic construct
MIWSSLVV

SEQ ID NO: 6437 - protein, 9 aa, Artificial Sequence
  synthetic construct
MQALQTPWT

SEQ ID NO: 6438 - protein, 9 aa, Artificial Sequence
  synthetic construct
LQNYNYPWT

SEQ ID NO: 6439 - protein, 9 aa, Artificial Sequence
  synthetic construct
MQGIHLPRT
